US011058763B2

(12) United States Patent
Zhang et al.

(10) Patent No.: US 11,058,763 B2
(45) Date of Patent: Jul. 13, 2021

(54) PORCINE EPIDEMIC DIARRHEA VIRUS STRAINS AND IMMUNOGENIC COMPOSITIONS THEREFROM

(71) Applicants: IOWA STATE UNIVERSITY RESEARCH FOUNDATION, INC., Ames, IA (US); ZOETIS SERVICES LLC, Parsippany, NJ (US)

(72) Inventors: Jianqiang Zhang, Ames, IA (US); Qi Chen, Ames, IA (US); Phillip Gauger, Ames, IA (US); Darin Madson, Ames, IA (US); John Morgan Hardham, Parsippany, NJ (US); Meggan Bandrick, Parsippany, NJ (US); Jay Gregory Calvert, Parsippany, NJ (US); James Richard Thompson, Parsippany, NJ (US); Mira Ivanova Stoeva, Parsippany, NJ (US); Walter Valdez, Parsippany, NJ (US)

(73) Assignees: Zoetis Services LLC, Parsippany, NJ (US); Iowa State University Research Foundation, Inc., Ames, IA (US)

( * ) Notice: Subject to any disclaimer, the term of this patent is extended or adjusted under 35 U.S.C. 154(b) by 101 days.

(21) Appl. No.: 15/556,446

(22) PCT Filed: Feb. 26, 2016

(86) PCT No.: PCT/US2016/019846

§ 371 (c)(1),
(2) Date: Sep. 7, 2017

(87) PCT Pub. No.: WO2016/138421

PCT Pub. Date: Sep. 1, 2016

(65) Prior Publication Data

US 2018/0064804 A1 Mar. 8, 2018

Related U.S. Application Data

(60) Provisional application No. 62/276,022, filed on Jan. 7, 2016, provisional application No. 62/250,961, filed (Continued)

(51) Int. Cl.
*A61K 39/215* (2006.01)
*C07K 14/165* (2006.01)

(Continued)

(52) U.S. Cl.
CPC ........... *A61K 39/215* (2013.01); *A61K 39/12* (2013.01); *C07K 14/165* (2013.01);

(Continued)

(58) Field of Classification Search
None
See application file for complete search history.

(56) References Cited

U.S. PATENT DOCUMENTS

| | | | |
|---|---|---|---|
| 5,084,269 | A | 1/1992 | Kullenberg |
| 6,814,971 | B2 | 11/2004 | Roberts et al. |

(Continued)

FOREIGN PATENT DOCUMENTS

| | | |
|---|---|---|
| CN | 103861098 | 6/2014 |
| CN | 104152578 | 11/2014 |

(Continued)

OTHER PUBLICATIONS 1-10000 bp of SEQ ID 36 alignment with GenEmbl db KF272920 by Marthaler et al 2013.*

(Continued)

*Primary Examiner* — Shanon A. Foley
(74) *Attorney, Agent, or Firm* — Vyacheslav Vasilyev

(57) ABSTRACT

The present invention is directed to novel nucleotide and amino acid sequences of Porcine Epidemic Diarrhea Virus (Continued)

("PEDV"), including novel genotypes thereof, all of which are useful in the preparation of vaccines for treating and preventing diseases in swine and other animals. Vaccines provided according to the practice of the invention are effective against multiple swine PEDV genotypes and isolates. Diagnostic and therapeutic polyclonal and monoclonal antibodies are also a feature of the present invention, as are infectious clones useful in the propagation of the virus and in the preparation of vaccines. Particularly important aspects of the invention include polynucleotide constructs that replicate in tissue culture and in host swine. The invention also provides for novel full length PEDV genomes that can replicate efficiently in host animals and tissue culture.

17 Claims, 198 Drawing Sheets
(87 of 198 Drawing Sheet(s) Filed in Color)

Specification includes a Sequence Listing.

Related U.S. Application Data on Nov. 4, 2015, provisional application No. 62/209,119, filed on Aug. 24, 2015, provisional application No. 62/121,955, filed on Feb. 27, 2015.

(51) Int. Cl.
*A61K 39/12* (2006.01)
*A61K 39/00* (2006.01)

(52) U.S. Cl.
CPC .... *A61K 2039/51* (2013.01); *A61K 2039/552* (2013.01); *C12N 2770/20034* (2013.01)

(56) References Cited

U.S. PATENT DOCUMENTS

| | | | |
|---|---|---|---|
| 2002/0155128 | A1 | 10/2002 | Knape et al. |
| 2004/0258701 | A1 | 12/2004 | Dominowski et al. |
| 2017/0202951 | A1 | 7/2017 | Marx et al. |

FOREIGN PATENT DOCUMENTS

| | | | |
|---|---|---|---|
| CN | 104262488 | | 1/2015 |
| CN | 104383528 | | 3/2015 |
| KR | 2010-0129247 | | 12/2010 |
| WO | WO 93/19779 | | 10/1993 |
| WO | WO 2015/153425 | A1 | 10/2015 |
| WO | WO 2015/179412 | A1 | 11/2015 |
| WO | WO 2016/007576 | A2 | 1/2016 |
| WO | WO 2016/022028 | A1 | 2/2016 |

OTHER PUBLICATIONS 10001-20000 bp of SEQ ID 36 alignment with GenEmbl db KF272920 by Marthaler et al 2013.*

Chen, Q., et al., GenBank: Accession No. KF650371, Dec. 20, 2013, Porcine epidemic diarrhea virus isolate ISU13-19338E-IN-passage3, complete genome, National Center for Biotechnology Information (NCBI).

Chen, Q., et al., GenBank: Accession No. KM975735, Feb. 2, 2016, Porcine epidemic diarrhea virus strain USA/NC/2013/35140, complete, genome, National Center for Biotechnology Information (NCBI).

Chen, Q., et al., GenBank: Accession No. KM975736, Feb. 2, 2016, Porcine epidemic diarrhea virus strain USA/IA/2013/49379, complete genome, National Center for Biotechnology Information (NCBI).

Chen, Q., et al., GenBank: Accession No. KM975737, Feb. 2, 2016, Porcine epidemic diarrhea virus strain USA/NC/2013/49469, complete genome, National Center for Biotechnology Information (NCBI).

Chen, Q., et al., GenBank: Accession No. KT860508, Feb. 8, 2016, Porcine epidemic diarrhea virus strain USA/IL20697/2014 Passage 5, complete genome, National Center for Biotechnology Information (NCBI).

Lee, S. & Lee, C. (2014). Outbreak-related porcine epidemic diarrhea virus strains similar to US strains, South Korea, 2013. Emerging Infectious Diseases, vol. 20, pp. 1223-1226.

Lee, S., Park, G. S., Shin, J. H. & Lee, C. (2014). Full-genome sequence analysis of a variant strain of porcine epidemic diarrhea virus in South Korea. Genome Announcements, vol. 2, No. 6.

Wang, L. et al., 2014, "New Variant of Porcine Epidemic Diarrhea Virus, United States," Emerging Infectious Diseases, vol. 20, pp. 917-919.

Wang, J. et al., 2013, "Porcine Epidemic Diarrhea Virus Variants with High Patogenicity, China," Emerging Infectious Diseases, vol. 19, pp. 2048-2049.

Chen, Q. et al., 2016, "Evaluation of serological cross-reactivity and cross-neutralization between the United States porcine epidemic diarrhea virus prototype and S-INDEL-variant strains," BMC Veterinary Research, vol. 12, pp. 1-10.

Pensaert, M. et al., 1978, "A New Coronavirus-Like Particle Associated With Diarrhea in Swine," Archives of Virology, vol. 58, pp. 243-247.

Chasey, D. et al., 1978, "Virus-like particles associated with porcine epidemic diarrhea," Research in Veterinary Science, vol. 25, pp. 255-256.

Wang, L. et al., 2014, "New Variant of Porcine Epidemic Diarrhea Virus, United States, 2014," Emerging Infectious Diseases, vol. 20, pp. 917-919.

Vlasova, A. et al., 2014, "Distinct Characteristics and Complex Evolution of PEDV Strains, North America, May 2013-Feb. 2014", Emerging Infectious Disease, vol. 20, pp. 1620-1628.

Park, S-J. et al., 2008, "Cloning and further sequence analysis of the ORF3 gene of wild- and attenuated-type porcine epidemic diarrhea viruses," Virus Genes, vol. 36, pp. 95-104.

Zhang, J. et al., 2014, "Reply to Classification of Emergent U.S. Strains of Porcine Epidemic Diarrhea Virus by Phylogenetic Analysis of Nucleocapsid and ORF3 Genes," Journal of Clinical Microbiology, vol. 52, pp. 3511-3514.

Song, D. S. et al., 2007, Oral efficacy of Vero cell attenuated porcine epidemic diarrhea virus DR13 strain, Research in Veterinary Science, vol. 82, pp. 134-140.

Park, S-J. et al., 2007, "Cloning and further sequence analysis of the spike gene of attenuated porcine epidemic diarrhea virus DR13," Virus Genes, vol. 35, pp. 55-64.

Song, D. et al., 2012, "Porcine epidemic diarrhea virus: a comprehensive review of molecular epidemiology, diagnosis, and vaccines," Virus Genes, vol. 44, pp. 167-175.

Oka, T. et al., 2014, "Cell culture isolation and sequence analysis of genetically diverse US porcine epidemic diarrhea virus strains including a novel strain with a large deletion in the spike gene," Veterinary Microbiology, vol. 173, pp. 258-269.

Marthaler, D., et al., GenBank: Accession No. KF272920, Aug. 14, 2013, Porcine epidemic diarrhea virus strain USA/Colorado/2013, complete genome, National Center for Biotechnology Information (NCBI).

Collin, E. et al., 2014, "An inactivated vaccine made from a U.S. field isolate of porcine epidemic disease virus is immunogenic in pigs, Running Title: PEDV inactivated vaccine," https://www.researchgate.net/profile/Faten_Okda/publication/264934006.

PCT International Search Report and Written Opinion, International Application No. PCT/US2015/039475, International filing date Jul. 8, 2015, dated Jan. 21, 2016.

Mogler, M. A. et al., 2014, "Development of an alphavirus RNA particle-based vaccine against porcine epidemic diarrhea virus", Proceedings of the American Association of Swine Veterinarians, Annual Meeting, pp. 63-64.

Jarvis, M. C. et al., 2016, "Genomic and evolutionary inferences between American and global strains of porcine epidemic diarrhea virus", Preventive Veterinary Medicine, vol. 123, pp. 175-184.

Marthaler, D. et al., 2013, "Complete Genome Sequence of Porcine Epidemic Diarrhea Virus Strain USA/Colorado/2013 from the United States", Genome Announcements, vol. 1, e00555-13.

(56) References Cited

OTHER PUBLICATIONS

Goji, N. A. et al., 2008, "Immune Responses of Healthy Subjects to a Single Dose of Intramuscular Inactivated Influenza A/Vietnam/1203/2004 (H5NI) Vaccine after Priming with an Antigenic Variant", The Journal of Infectious Diseases, vol. 198, pp. 635-641.

Nabel, G. J., 2001, "Challenges and opportunities for development of an AIDS vaccine", Nature, vol. 410, pp. 1002-1007.

Woo, P. C. Y. et al., 2012, Discovery of Seven Novel Mammalian and Avian Coronaviruses in the Genus *Deltacoronavirus* Supports Bat Coronaviruses as the Gene Source of *Alphacoronavirus* and *Betacoronavirus* and Avian Coronaviruses as the Gene Source of *Gammacoronavirus* and *Deltacoronavirus*, Journal of Virology, vol. 86, pp. 3995-4008.

Wang, L. et al., "New Variant of Porcine Epidemic Diarrhea Virus, United States, 2014" Emerging Infectious Diseases, May 2014, vol. 20, pp. 917-919.

Wang, J. et al. "Porcine Epidemic Diarrhea Virus Variants with High Pathogenicity, China", Emerging Infectious Diseases, Dec. 2013, vol. 19, pp. 2048-2049.

Chen, Q. et al. "Evaluation of serological cross-reactivity and cross-neutralization between the United States porcine epidemic diarrhea virus prototype and S-INDEL-variant strains," BMC Veterinary Research, 2016, vol. 12, pp. 1-10.

PCT International Search Report and Written Opinion, International Application No. PCT/US2016/019846, International filing date Feb. 26, 2016, dated Jul. 29, 2016.

Hanke, D. et al., 2015, Comparison of Porcine Epidemic Diarrhea Viruses from Germany and the United States, 2014, Emerging Infectious Diseases, vol. 21, pp. 493-496.

Hanke, D. et al., GenBank: Accession No. LM645057, Dec. 16, 2014, Porcine epidemic diarrhea virus L00721/GER/2014, complete genome, National Center for Biotechnology Information (NCBI).

Van Diep, N. et al., 2015, US-like isolates of porcine epidemic diarrhea virus from Japanese outbreaks between 2013 and 2014, SpringerPlus, vol. 4, p. 756 misnumbered as vol. 586, p. 384 in ISR of PCT/US2016/012899.

Van Diep, N. et al., GenBank: Accession No. KT968517, Dec. 14, 2015, Porcine epidemic diarrhea virus strain 96P4-C6 truncated nonstructural protein (ORF3) gene, complete cds, National Center for Biotechnology Information (NCBI).

Park, Seong-Jun et al., 2008, "Cloning and further sequence analysis of the ORF3 gene of wild- and attenuated-type porcine epidemic diarrhea viruses", Virus Genes, vol. 36, pp. 95-104.

Song, D. S. et al., 2003, "Differentiation of a Vero cell adapted porcine epidemic diarrhea virus from Korean field strains by restriction fragment length polymorphism analysis of ORF 3", Vaccine, vol. 21, pp. 1833-1842.

Zhang, X. et al., GenBank: Accession No. KP870122, Aug. 25, 2015, Porcine epidemic diarrhea virus isolate CH/GD-12/2013 spike protein (S) gene, complete cds, National Center for Biotechnology Information (NCBI).

Li, W. et al., 2012, "New Variants of Porcine Epidemic Diarrhea Virus, China, 2011", Emerging Infectious Diseases, vol. 18, pp. 1350-1353.

Li, W. et al., GenBank: Accession No. JN980698, Aug. 15, 2012, Porcine epidemic diarrhea virus isolate CHGD-01 spike protein (S) gene, complete cds, National Center for Biotechnology Information (NCBI).

PCT International Search Report and Written Opinion, International Application No. PCT/US2016/012899, International filing date Jan. 11, 2016, dated Oct. 7, 2016.

Balasch, M. et al., 2018, "Vaccination of 1-day-old pigs with a porcine reproductive and respiratory syndrome virus (PRRSV) modified live attenuated virus vaccine is able to overcome maternal immunity", Porcine Health Management, vol. 4, pp. 1-11.

Park, S.J. et al., GenBank: Accession No. JQ023162, May 5, 2012, Porcine epidemic diarrhea virus strain attenuated DR13, complete genome, National Center for Biotechnology Information (NCBI).

\* cited by examiner

Fig. 3A

S1 Sequence USA/IL/2014/ISUcase2 (SEQ ID NO:1)

ATGAAGTCTTTAAATTACTTCTGGTTGTTCTTACCAGTACTTTCAACACTCAGCCTACCACAAGATGTCACTAGGTGCCA
GTCCACTATTAACTTCAGGCGGTTCTTTTCAAAATTTAATGTGCAGGCACCTGCTGTCGTTGTGTTGGGTGGTTATCTAC
CTAGTATGAATTCCTCTAGCTGGTACTGTGGCACAGGTCTTGAAACTGCTAGTGGCGTGCATGGTATTTTCCTCAGTTAC
ATCGATGCTGGTCAGGGCTTTGAGATTGGCATTTCACAGGAGCCGTTTGATCCTAGTGGTTACCAGCTTTATTTACATAA
GGCCACTAATGGTAACCATAATGCTATTGCACGACTGCGCATTTGCCAGTTTCCAGATAATAAAACATTGGGCCCTACTG
TTAATGATGTTACAACAGGTCGTAACTGCCTATTCAACAAAGCCATTCCAGCTTATATGCAGGATGGAAAAAATATCGTT
GTCGGCATAACATGGGACAATGATCGTGTCACTGTTTTGCTGACAAGATCTATCATTTTTATCTTAAAAATGATTGGTC
CCGTGTTGCGACAAGATGTTACAATAAAAGAAGTTGTGCTATGCAATATGTTTATACACCTACCTACTACATGCTTAATG
TTACTAGTGCAGGTGAGGATGGCATTTATTATGAACCATGTACAGCTAATTGCAGTGGTTACGCTGCCAATGTGTTTGCC
ACTGATTCTAATGGCCACATACCAGAAGGTTTTAGTTTTAATAATTGGTTTCTTTTGTCCAATGATTCCACTTTGTTGCA
TGGTAAGGTGGTTTCCAACCAACCTTTGTTGGTCAATTGTCTTTTGGCCATTCCTAAGATTTATGGACTAGGCCAATTTT
TCTCATTCAATCAAACGATGGATGGCGTTTGTAATGGAGCTGCTGCGCAGCGTGCACCAGAGGCTCTGAGGTTTAATATT
AATGACACCTCTGTCATTCTTGCTGAAGGCTCAATTGTACTTCATACTGCTTTAGGAACAAATCTTTCTTTTGTTTGCAG
TAATTCTTCAGATCCTCATCTAGCTACCTTCGCCATACCTCTGGGTGCTACCCAAGTACCTTATTATTGTTTCTTAAAG
TGGATACTTACAACTCCACTGTTTATAAATTTTGGCTGTTTTACCTCCTACCGTCAGGGAAATTGTCATCACCAAGTAT
GGTGATGTTTATGTCAATGGGTTTGGATACTTGCATCTCGGTTTGTTGGATGCTGTCACAATTAATTTCACTGGTCATGG
CACTGACGATGATGTTTCTGTTTTTGGACCATAGCATCGACTAATTTTGTTGATGCACTCATCGAAGTTCAAGGAACCG
CCATTCAGCGTATTCTTTATTGTGATGATCCTGTTAGCCAACTCAAGTGTTCTCAGGTTGCTTTTGACCTTGACGATGGT
TTTTACCCTATTTCTTCTAGAAACCTTCTGAGTCATGAACAGCCAATTTCTTTTGTTACTCTGCCATCATTTAATGATCA
TTCTTTTGTTAACATTACTGTATCTGCTTCCTTTGGTGGTCATAGTGGTGCCAACCTTATTGCATCTGACACTACTATCA
ATGGGTTTAGTTCTTTCTGTGTTGACACTAGACAATTTACCATTTCACTGTTTTATAACGTTACAAACAGTTATGGTTAT
GTGTCTAAATCACAGGACAGTAATTGCCCTTTCACCTTGCAATCTGTTAATGATTACCTGTCTTTTAGCAAATTTTGTGT
TTCCACCAGCCTTTTGGCTAGTGCCTGTACCATAGATCTTTTTGGTTACCCTGAGTTTGGTAGTGGTGTTAAGTTTACGT
CCCTTTACTTTCAATTCACAAAGGGTGAGTTGATTACTGGCACGCCTAAACCACTTGAAGGTGTCACGGACGTTTCTTTT
ATGACTCTGGATGTGTGTACCAAGTATACTATCTATGGCTTTAAAGGTGAGGGTATCATTACCCTTACAAATTCTAGCTT
TTTGGCAGGTGTTTATTACACATCTGATTCTGGACAGTTGTTAGCCTTTAAGAATGTCACTAGTGGTGCTGTTTATTCTG
TTACGCCATGTTCTTTTTCAGAGCAGGCTGCATATGTTGATGATGATATAGTGGGTGTTATTTCTAGTTTGTCTAGCTCC
ACTTTTAACAGTACTAGGGAGTTGCCTGGTTTCTTCTACCATTCT

Fig. 3B

S-INDEL-variant PEDV isolate 2014020697-P5 passage 5, lineage 1 (SEQ ID NO:8)
ACTTAAAAAGATTTTCTATCTACGGATAGTTAGCTCTTTTTCTAGACTCTTGTCTACTCAATTCAACTAAACGAAATTTGTC
CTTCCGGCCGCATGTCCATGCTGCTGGAAGCTGACGTGGAATTTCATTAGGTTTGCTTAAGTAGCCATCGCAAGTGCTGTGCT
GTCCTCTAGTTCCTGGTTGGCGTTCCGTCGCCTTCTACATACTAGACAAACAGCCTTCCTCCGGTTCCGTCTGGGGGTTGTGT
GGATAACTAGTTCCGTCTAGTTTGAAACCAGTAACTGTCGGCTATGGCTAGCAACCATGTTACATTGGCTTTTGCCAATGATG
CAGAAATTTCAGCTTTTGGCTTTTGCACTGCTAGTGAAGCCGTCTCATACTATTCTGAGGCCGCCGCTAGTGGATTTATGCAA
TGCCGTTTCGTGTCCTTCGATCTCGCTGACACTGTTGAGGGATTGCTTCCCGAAGACTATGTCATGGTGGTGGTCGGCACTAC
CAAGCTTAGTGCGTATGTGGACACTTTTGGTAGCCGCCCCAAAAACATTTGTGGTTGGCTGTTATTTTCAACTGTAATTACT
TCCTCGAAGAGTTAGAGCTTACTTTTGGTCGTCGTGGTGGTAACATCGTGCCAGTTGACCAATACATGTGTGGCGCTGACGGT
AAACCTGTTCTTCAGGAATCCGAATGGGAGTATACAGATTTCTTTGCTGACTCCGAAGACGGTCAACTCAACATTGCTGGTAT
CACTTATGTGAAGGCCTGGATTGTAGAGCGATCTGATGTCTCTTATGCGAGTCAGAATTTAACATCTATTAAGTCTATTACTT
ACTGTTCAACCTATGAGCATACTTTTCCTGATGGTACTGCCATGAAGGTTGCACGTACTCCAAAGATTAAGAAGACTGTTGTC
TTGTCTGAGCCACTTGCTACTATCTACAGGGAAATTGGTTCTCCTTTTGTGGATAATGGGAGCGATGCTCGTTCTATCATTAA
GAGACCAGTGTTCCTCCACGCTTTTGTTAAGTGTAAGTGTGGTAGTTATCATTGGACTGTTGGTGATTGGACTTCCTATGTCT
CCACTTGCTGTGGCTTTAAGTGTAAGCCAGTCCTTGTGGCTTCATGCTCTGCTACGCCTGGTTCTGTTGTGGTTACGCGCGCT
GGTGCTGGCACTGGTGTTAAGTATTACAACAACATGTTCCTGCGCCATGTGGCAGACATTGATGGGTTGGCATTCTGGCGAAT
TCTCAAGGTGCAGTCCAAAGACGACCTCGCTTGCTCTGGTAAATTCCTTGAACACCATGAGGAAGGTTTCACAGATCCTTGCT
ACTTTTTGAATGACTCGAGCATTGCTACTAAGCTCAAGTTTGACATCCTTAGTGGCAAGTTTCTGATGAAGTCAAACAAGCT
ATCTTTGCTGGTCATGTTGTTGTTGGCAGCGCGCTCGTTGACATTGTTGACGATGCACTGGGACAGCCTTGGTTTATACGTAA
GCTTGGTGACCTTGCAAGTGCAGCTTGGGAGCAGCTTAAGGCTGTCGTTAGAGGCCTTAACCTCCTGTCTGATGAGGTCGTGC
TCTTTGGCAAAAGACTTAGCTGTGCCACTCTTAGTATCGTTAACGGTGTTTTTGAGTTCATCGCCGAAGTGCCTGAGAAGTTG

```
GCTGCGGCTGTTACAGTTTTTGTCAACTTCTTGAATGAGCTTTTTGAGTCTGCCTGTGACTGCTTAAAGGTCGGAGGTAAAAC
CTTTAACAAGGTTGGCTCTTATGTTCTTTTTGACAACGCATTGGTTAAGCTTGTCAAGGCAAAAGTTCGCGGCCCACGACAGG
CAGGTGTTTGTGAAGTTCGTTACACAAGCCTTGTTATTGGGAGTACTACCAAGGTGGTTTCCAAGCGCGTTGAAAATGCCAAT
GTGAATCTCGTCGTCGTTGACGAGGATGCGACCCTCAACACCACTGGTCGTACAGTTGTTGTTGACGGACTTGCATTCTTCGA
GAGTGACGGGTTTTACAGACATCTTGCTGATGCTGACGTTGTCATTGAACATCCTGTTTATAAGTCTGCTTGTGAGCTCAAGC
CAGTTTTTGAGTGTGACCCAATACCTGATTTTCCTATGCCTGTGGCCGCTAGTGTTGCAGAGCTTTGTGTGCAAACTGATCTG
TTGCTTAAAAATTACAACACTCCTTATAAAACTTACAGCTGCGTTGTGAGAGGTGATAAGTGTTGTATCACTTGTACCTTACA
TTTCACAGCACCAAGTTATATGGAGGCTGCTGCTAATTTTGTAGACCTCTGTACCAAGAACATTGGTACTGCTGGTTTTCATG
AGTTTTACATTACGGCCCATGAACAACAGGATCTGCAAGGGTTTGTAACCACTTGTTGCACGATGTCAGGTTTTGAGTGTTTT
ATGCCTATAATCCCACAGTGTCCAGCAGTGCTTGAAGAGATTGATGGTGGTAGCATCTGGCGGTCTTTTATCACTGGTCTTAA
TACAATGTGGGATTTTTGCAAGCATCTTAAAGTCAGCTTGACTAGATGGCATTGTTGTCACTGTAGCACGCAAATTTAAAC
GACTTGGTGCTCTCTTGGCAGAAATGTATAACACTTACCTTTCAACTGTGGTGGAAAACTTGGTACTGGCCGGTGTTAGCTTC
AAGTATTATGCCACCAGTGTCCCAAAAATTGTTTTGGGCTGTTGTTTTCACAGTGTTAAAAGTGTTCTTGCAAGTGCCTTCCA
GATTCCTGTCCAGGCAGGCGTTGAGAAGTTTAAAGTCTTCCTTAACTGTGTTCACCCTGTTGTACCACGTGTCATTGAAACTT
CTTTTGTGGAATTAGAAGAGACGACATTTAAACCACCAGCACTCAATGGTAGTATTGCTATTGTTGATGGCTTTGCTTTCTAT
TATGATGGAACACTATACTATCCCACCGATGGTAATAGCGTTGTTCCTATCTGCTTTAAGAAGAAAGGTGGTGGTGATGTCAA
ATTCTCTGATGAAGTCTCTGTTAAAACCATTGACCCAGTTTATAAGGTCTCCCTTGAATTTGAGTTCGAGTCTGAGACTATTA
TGGCTGTGCTTAATAAGGCTGTTGGTAATTGTATCAAGGTTACAGGTGGTTGGGACGATGTTGTTGAGTATATCAATGTTGCC
ATTGAGGTTCTTAAAGATCACATCGATGTGCCTAAGTACTACATCTATGATGAGGAAGGTGGCACCGATCCTAATCTGCCCGT
AATGGTTTCTCAGTGGCCGTTGAATGATGACACGATCTCACAGGATCTGCTTGATGTTGAAGTTGTTACTGATGCGCCAGTTG
ATTTCGAGGGTGATGAAGTAGACTCCTCTGACCCTGATAAGGTGGCAGACGTGGCTAACTCTGAGCCTGAGGATGACGGTCTT
AATGTAGCTCCTGAAACAAATGTAGAGTCTGAAGTTGAGGAAGTTGCCGCAACCTTGTCCTTTATTAAAGATACACCTTCCAC
AGTTACTAAGGATCCTTTTGCTTTTGACTTTGCAAGCTATGGAGGACTTAAGGTTTTAAGACAATCTCATAACAACTGCTGGG
TTACTTCTACCTTGGTGCAGCTACAATTGCTTGGCATCGTTGATGACCCTGCAATGGAGCTTTTTAGTGCTGGTAGAGTTGGT
CCAATGGTTCGCAAATGCTATGAGTCACAAAAGGCTATCTTGGGATCTTTGGGTGATGTGTCGGCTTGCCTAGAGTCTCTGAC
TAAGGACCTACACACACTTAAGATTACCTGTTCTGTAGTCTGTGGTTGTGGTACTGGTGAACGTATCTATGATGGTTGTGCTT
TTCGTATGACGCCAACTTTGGAACCGTTCCCATATGGTGCTTGTGCTCAGTGTGCTCAAGTTTTGATGCACACTTTTAAAGT
ATTGTTGGCACCGGCATCTTTTGTCGAGATACTACTGCTCTCTCCTTGGATTCTTTGGTTGTAAAACCTCTTTGTGCGGCTGC
TTTTATAGGCAAGGATAGTGGTCATTATGTCACTAACTTTTATGATGCTGCTATGGCTATTGATGGTTATGGTCGTCATCAGA
TAAAGTATGACACACTGAACACTATTTGTGTTAAAGACGTTAATTGGACAGCACCTTTTGTCCCAGACGTTGAGCCTGTATTG
GAGCCTGTTGTCAAACCTTTCTATTCTTATAAGAATGTTGATTTTTACCAAGGAGATTTTAGTGACCTTGTTAAACTTCCATG
TGATTTTGTTGTTAATGCTGCAAATGAGAATTTGTCTCACGGTGGCGGACATAGCAAAGGCCATTGATGTTTATACCAGGGCA
TGTTGCAGAAGTGCTCGAATGATTACATTAAAGCACACGGTCCCATTAAAGTTGGACGTGGTGTCATGTTGGAGGCATTAGGT
CTTAAGGTCTTTAATGTTGTTGGTCCACGTAAGGGTAAGCATGCACCTGAGCTTCTTGTTAAGGCTTATAAGTCCGTTTTTGC
TAATTCAGGTGTTGCTCTTACACCTTTGATTAGTGTTGGAATTTTTAGTGTTCCTTTGGAAGAATCTTTATCTGCTTTTCTTG
CATGTGTTGGTGATCGCCACTGTAAGTGCTTTTGTTATAGTGACAAAGAGCGCGAGGCGATCATTAATTACATGGATGGCTTG
GTAGATGCTATTTTCAAAGATGCACTTGTTGATACTACTCCTGTCCAGGAAGATGTTCAACAAGTTTCACAAAAACCAGTTTT
GCCTAATTTTGAACCTTTCAGGATTGAAGGTGCTCATGCTTTCTATGAGTGCAACCCTGAAGGTTTGATGTCATTAGGTGCTG
ACAAGCTGGTGTTGTTTACAAATTCCAATTTGGATTTTTGTAGCGTTGGTAAGTGTCTTAACAATGTGACTGGCGGTGCATTG
CTTGAAGCCATAAATGTATTTAAAAAGAGTAACAAAACAGTGCCTGCTGGCAACTGTGTTACTTTTGAGTGTGCAGATATGAT
TTCTATTACTATGGTAGTATTGCCATCTGACGGTGATGCTAATTATGACAAAAATTATGCACGCGCCGTCGTCAAGGTATCTA
AGCTTAAAGGCAAGTTATTGCTTGCTGTTGGTGATGCCATGTTGTATTCCAAGTTGTCCCACCTCAGCGTGTTAGGTTTCGTA
TCCACACCTGATGATGTGGAGCGTTTCTACGCAAATAAGAGTGTGGTTATTAAAGTTACTGAGGATACACGTAGTGTTAAGAC
TGTTAAAGTAGAATCCACTGTTACTTATGGACAACAAATTGGACCTTGTCTTGTTAATGACACCGTTGTCACAGACAACAAAC
CTGTTGTTGCTGATGTTGTAGCTAAGGTTGTACCAAGTGCTAATTGGGATTCACATTATGGTTTTGATAAGGCTGGTGAGTTC
CACATGCTAGACCATACTGGGTTTGCCTTTCCTAGTGAAGTTGTTAACGGTAGGCGTGTGCTTAAAACCACAGATAATAACTG
TTGGGTTAATGTTACATGTTTACAATTACAGTTTGCTAGATTTAGGTTCAAGTCAGCAGGTCTACAGGCTATGTGGGAGTCCT
ATTGTACTGGTGATGTTGCTATGTTTGTGCATTGGTTGTACTGGCTTACTGGTGTTGACAAAGGTCAGCCTAGTGATTCAGAA
AATGCACTTAACATGTTGTCTAAGTACATTGTTCCTGCTGGTTCTGTCACTATTGAACGTGTCACGCATGACGGTTGTTGTTG
TAGTAAGCGTGTTGTCACTGCACCAGTTGTGAATGCTAGCGTGTTGAAGCTTGGCGTCGAGGATGGTCTTTGTCCACATGGTC
TTAACTACATTGACAAAGTTGTTGTAGTTAAAGGTACTACAATTGTTGTCAATGTTGGAAACCTGTAGTGGCACCATCGCAC
CTCTTCTTAAGGGTGTTTCCTACACAACATTCCTAGATAATGGTAACGGTGTTGCCGGCATTATACTGTTTTGATCATGA
CACTGGTATGGTGCATGATGGAGATGTTTTTGTACCAGGTGATCTCAATGTGTCTCCTGTTACAAATGTTGTCGTCTCAGAGC
AGACGGCTGTTGATTAAAGACCCTGTGAAGAAAGTAGAGTTAGCGCTACAAAAGCTGTTAGCACATGTGTTAGCACTATTATGCG
GAAAGATTCTTTTCCTTTGGTGATTTTATGTCACGTAATTTAATTACAGTGTTTTTGTACATCCTTAGTATTTTGGGTCTCTG
TTTTAGGGCCTTTCGTAAGAGGGATGTTAAAGTTCTAGCTGGTGTACCCCAACGTACTGGTATTATATTGCGTAAAAGTGTGC
GCTATAATGCAAAGGCTTTGGGTGTCTTCTTCAAGCTAAAACTTTATTGGTTCAAAGTTCTTGGTAAGTTTAGTTTGGGTATT
TATGCATTGTATGCATTACTATTCATGACAATACGCTTTACACCCTATAGGTGGCCCTGTTTGTGATGATGTTGTTGCTGGTTA
TGCTAATTCTAGTTTTGACAAGAATGAGTATTGCAACAGTGTTATTTGTAAGGTCTGTCTCTATGGGTACCAGGAACTTTCGG
```

Fig. 3B2

```
ACTTCTCTCACACACAGGTAGTATGGCAACACCTTAGAGACCCATTAATTGGTAATGTGATGCCTTTCTTTTATTTGGCATTT
CTGGCAATTTTTGGGGGTGTTTATGTAAAGGCTATTACTCTCTATTTTATTTTCCAGTACCTTAACATTCTTGGTGTGTTTTT
GGGCCTACAACAGTCCATTTGGTTTTTGCAGCTTGTGCCTTTTGATGTCTTTGGTGACGAGATCGTCGTCTTTTTCATCGTTA
CACGCGTATTGATGTTCCTTAAGCATGTTTTCCTTGGCTGCGATAAGGCATCTTGTGTGGCTTGCTCTAAGAGTGCTCGCCTT
AAGCGCGTTCCTGTCCAGACTATTTTTCAGGGTACTAGCAAATCCTTCTACGTACATGCCAATGGTGGTTCTAAGTTCTGTAA
GAAGCACAATTTCTTTTGTTTAAATTGTGATTCTTATGGTCCAGGCTGCACTTTTATTAATGACGTCATTGCAACTGAAGTTG
GTAATGTTGTCAAACTTAATGTGCAACCGACAGGTCCTGCCACTATTCTTATTGACAAGGTTGAATTCAGTAATGGTTTTTAC
TATCTTTATAGTGGTGACACATTTTGGAAGTACAACTTTGACATAACAGATAACAAATACACTTGCAAAGAGTCACTTAAAAA
TTGTAGCATAATCACAGACTTTATTGTTTTTAACAATAATGGTTCCAATGTAAATCAGGTTAAGAATGCATGTGTGTATTTTT
CACAGATGCTTTGTAAACCTGTTAAGTTAGTGGACTCAGCGTTGTTGGCCAGTTTGTCTGTTGATTTTGGTGCAAGCTTACAT
AGTGCTTTTGTTAGTGTGTTGTCGAATAGTTTTGGCAAAGACCTGTCAAGTTGTAATGACATGCAGGATTGCAAGAGCACATT
GGGTTTTGATGATGTACCATTGGATACCTTTAATGCTGCTGTTGCTGAGGCTCATCGTTACGATGTCCTCTTGACTGACATGT
CGTTCAACAATTTTACCACCAGTTATGCAAAACCAGAGGAAAAACTTCCCGTCCATGACATTGCCACGTGTATGCGTGTAGGT
GCCAAGATTGTTAATCATAACGTTCTTGTCAAGGATAGTATACCTGTGGTGTGGCTTGTACGTGATTTCATTGCCCTTTCTGA
AGAAACTAGGAAGTACATTATTCGTACGACTAAAGTTAAGGGTATAACCTTCATGTTGACCTTTAATGATTGTCGTATGCATA
CTACCATACCTACTGTTTGCATTGCAAATAAGAAGGGTGCAGGTCTTCCTAGTTTTTCAAAGGTTAAGAAATTCTTCTGGTTT
TTGTGTCTGTTCATAGTTGCTGTTTTCTTTGCACTAAGCTTTTTTGATTTTAGTACTCAGGTTAGCAGTGATAGTGATTATGA
CTTCAAGTATATTGAGAGTGGCCAGTTGAAGACTTTTGACAATCCACTTAGTTGTGTGCATAATGTCTTTAGTAACTTCGACC
AGTGGCATGATGCCAAGTTTGGTTCTCACCCCCGTCAACAATCCTAGTTGTCCTATAGTCGTTGGTGTATCAGACGAAGCGCGC
ACTGTTCCAGGTATCCCAGCAGGTGTTTATTTAGCTGGTAAAACACTTGTTTTTGCTATTAACACCATTTTTGGTACATCTGG
TTTGTGCTTTGATGCTAGTGGCGTTGCTGATAAGGGCGCTTGCATTTTTAATTCGGCTTGCACCACATTATCGGTTTGGGTG
GAACTGCTGTCTACTGTTATAAGAATGGTCTAGTTGAAGGTGCTAAACTTTATAGTGAGTTGGCACCTCATAGCTACTATAAA
ATGGTAGATGGTAATACTGTGTCTTTACCTGAAATTATCTCACGCGGCTTTGGCATCCGTACTATCCGTACAAAGGCTATGAC
CTACTGTCGCGTTGGCCAGTGTGTGCAATCTGCAGAAGGTGTTTGTTTTGGCGCCGATAGATTCTTTGTCTATAATGCAGAAT
CTGGTTCTGACTTTGTTTGTGGCACAGGGCTCTTTACATTGTTGATGAACGTTATTAGTGTTTTTTCCAAGACAGTACCAGTA
ACTGTGTTGTCTGGTCAAATACTTTTTAATTGCATTATTGCTTTTGCTGCTGTTGCGGTGTGTTTCTTATTTACAAAGTTTAA
GCGCATGTTCGGTGATATGTCTGTTGGCGTTTTCACTGTCGGTGCTTGTACTTTGTTGAACAATGTTTCCTACATTGTAACAC
AGAACACACTTGGCATGTTGGGCTATGCAACTTTGTACTTTTTGTGCACTAAAGGTGTTAGATATATGTGGATTGGCATTTG
GGATTTTTGATCTCATATATACTTATTGCACCATGGTGGGTTTTGATGGTTTATGCCTTTTCAGCCATTTTTGAGTTTATGCC
TAACCTTTTTAAGCTTAAGGTTTCAACACAACTTTTTGAGGGTGACAAGTTCGTAGGCTCTTTTGAAAATGCTGCAGCAGGTA
CATTTGTGCTTGATATGCATGCCTATGAGAGACTTGCCAACTCTATCTCAACTGAAAAACTGCGTCAGTATGCTAGTACTTAC
AATAAGTACAAGTATTATTCAGGCAGTGCTTCAGAGGCTGCTTACAGGCTTCTTGTTTTGCCCATTTGGCCAAGGCTATGAT
GGATTATGCTTCTAATCACAACGACACGTTATACACACCACCCACTGTGAGTTACAATTCAACTCTACAGGCTGGCTTGCGTA
AGATGGCACAACCATCTGGTGTTGTTGAGAAGTGCATAGTTCGTGTTTGCTATGGTAATATGGCTCTTAATGGCCTATGGCTT
GGTGATACTGTTATCTGCCCACGCCATGTTATAGCGTCTAGTACTACTAGCACTATAGATTATGACTATGCCCTTTCTGTTTT
ACGCCTCCACAACTTCTCCATTTCATCTGGTAATGTTTTCCTAGGTGTTGTGGGTGTAACCATGCGAGGTGCTTTGTTGCAGA
TAAAGGTTAATCAAAACAATGTCCACACGCCTAAGTACACCTATCGCACAGTTAGACCGGGTGAATCTTTTAATATCTTGGCG
TGCTATGATGGTTCTGCAGCTGGTGTTTACGGCGTTAACATGCGCTCTAATTACACTATTAGAGGCTCGTTCATTAATGGCGC
TTGTGGTTCACCTGGTTATAACATTAACAATGGTACCGTTGAGTTTTGCTATTTACACCAGCTTGAACTTGGTCAGGCTGTC
ATGTTGGTAGCGACTTAGATGGTGTTATGTATGGTGGTTATGAGGACCAACCTACTTTGCAAGTTGAAGGCGCTAGTAGTCTG
TTTACAGAGAATGTGTTGGCATTTCTTTATGCAGCACTCATTAATGGTTCTACCTGGTGGCTTAGTTCTTCTAGGATTGCTGT
AGACAGGTTTAATGAGTGGGCTGTTCATAATGGTATGACAACAGTAGTTAATACTGATTGCTTTTCTATTCTTGCTGCTAAGA
CTGGTGTTGATGTACAACGTTTGTTGGCCTCAATCCAGTCTCTGCATAAGAATTTTGGTGGAAAGCAAATTCTTGGCTATACC
TCGTTGACAGATGAGTTTACTACAGGTGAAGTTATACGTCAAATGTATGGCGTTAATCTTCAGAGTGGTTATGTTTCACGCGC
CTGTAGAAATGTCTTGCTGGTTGGTTCTTTTCTGACTTTCTTTTGGTCAGAATTAGTTTCCTACACTAAGTTCTTTTGGGTAA
ATCCTGGTTATGTCACACCTATGTTTGCGTGTTTGTCATTGCTGTCCTCACTTTTGATGTTCACACTCAAGCATAAGACATTG
TTTTTCCAGGTCTTTCTAATACCTGCTCTGATTGTTACATCTTGCATTAATTGGCATTTGATGTTGAAGTCTACAACTATTT
GGCAGAGCATTTTGATTACCATGTTTCTCTCATGGGTTTTAATGCACAAGGTCTTGTTAACATCTTTGTCTGCTTTGTTGTTA
CCATTTTACACGGCACATACACATGGCGCTTTTTAACACACCTGTGAGTTCTGTCACTTATGTGGAGCTTTGCTGACTGCG
GCATATAACTATTTTTACGCTAGTGACATTCTTAGTTGTGCTATGACACTATTTGCTAGTGTGACTGGCAACTGGTCGTTGG
TGCTGTTTGTTATAAAGCTGCTGTTTATATGGCCTTGAGATTTCCTACTTTTGTGGCTATTTTGGTGATATTAAGAGTGTTA
TGTTCTGTTACCTTGTGTTGGGTTATTTTACCTGTTGCTTCTACGGTATTCTACTGGTTCAACAGGTTTTTTAAGGTTAGT
GTAGGTGTCTATGACTATACTGTTAGTGCTGCTGAGTTTAAGTATATGGTTGCTAACGGCCTACGTGCACCAACTGGAACACT
TGATTCACTTCTGTCTGCCAAATTGATTGGTGGTCGGGAGAATATTAAGATTCTTCCGTTCAGTCTAAACTGA
CTGATATTAAGTGTAACTGTGCTTTTAGGCTGTCTCTCTAGCATGAATGTTTCAGCAAATTCAACAAATGGGTCCTAT
TGTGTTGACTTGCATAACAAGATCAACTTGTGTAATGACCCAGAAAAAGCGCAGGAAATGCTACTTGCTTTGTTGGCATTTTT
CCTTAGTAAGAATAGTGCTTTTGGTTTAGATGACTTATTGGAATCCTATTTTAATGACAATAGTATGTTGCAGAGTGTTGCAT
CTACTTATGTCGGTTTGCCTTCTTATGTCATTTATGAAAATGCACGCCAACAGTATGAAGATGCTGTTAATAATGGTTCTCCA
CCTCAGTTGGTTAAGCAATTGCGCCATGCCATGAATGTAGCAAAGAGCGAATTTGACCGTGAGGCTTCTACTCAGCGTAAGCT
```

Fig. 3B3

```
TGATAGAATGGCGGAACAGGCTGCAGCACAGATGTACAAAGAGGCACGAGCAGTTAATAGGAAGTCCAAAGTTGTAAGTGCTA
TGCATTCACTGCTTTTTGGTATGTTGAGACGTTTGGACATGTCTTCTGTAGACACCATTCTCAACTTGGCAAAGGATGGGGTT
GTACCTCTGTCTGTCATACCGGCAGTCAGTGCTACTAAGCTTAACATTGTTACTTCTGATATCGATTCTTATAATCGTATCCA
GCGTGAGGGATGTGTCCACTACGCTGGTACCATTTGGAATATAATTGATATCAAGGACAATGATGGCAAGGTGGTACACGTTA
AGGAGGTAACCGCACAGAATGCTGAGTCCCTGTCATGGCCCTGGTCCTTGGGTGTGAGCGTATTGTCAAGCTCCAGAATAAT
GAAATTATTCCTGGTAAGCTGAAGCAGCGCTCCATTAAGGCAGAAGGAGATGGCATAGTTGGAGAAGGTAAGGCACTTTACAA
TAATGAGGGTGGACGTACTTTTATGTATGCTTTCATCTCGGACAAACCGGACCTGCGTGTAGTCAAGTGGGAGTTCGATGGTG
GTTGTAACACTATTGAGCTAGAACCACCACGTAAGTTCTTGGTGGATTCTCCTAATGGTGCACAGATCAAGTATCTCTACTTT
GTTCGTAACCTTAACACGTTACGTAGGGGTGCTGTTCTCGGCTACATAGGTGCCACTGTACGCTTGCAGGCTGGTAAACAAAC
AGAACAGGCTATTAACTCTTCATTGTTGACACTTTGCGCTTTCGCTGTGGATCCTGCTAAGACCTACATCGATGCTGTCAAAA
GTGGTCACAAACCAGTAGGTAACTGTGTTAAGATGTTGGCCAATGGTTCTGGTAATGGACAAGCTGTTACTAATGGTGTGGAG
GCTAGTACTAACCAGGATTCATACGGTGGTGCGTCCGTGTGTCTATATTGTAGAGCACATGTTGAGCATCCATCTATGGATGG
TTTTTGCAGACTGAAAGGCAAGTACGTACAGGTTCCACTAGGTACAGTGGATCCTATACGTTTTGTACTTGAGAATGACGTTT
GCAAGGTTTGTGGTTGTTGGCTGGCTAATGGCTGCACTTGTGACAGATCCATTATGCAAAGCACTGATATGGCTTATTTAAAC
GAGTACGGGGCTCTAGTGCAGCTCGACTAGAGCCCTGTAACGGTACTGATACACAACATGTGTATCGTGCTTTTGACATCTAC
AACAAGGATGTTGCTTGTCTAGGTAAATTCCTCAAGGTGAACTGTGTTCGCCTGAAGAATTTGGATAAGCATGATGCATTCTA
TGTTGTCAAAAGATGTACCAAGTCTGCGATGGAACACGAGCAATCCATCTATAGCAGACTTGAAAAGTGTGGAGCCGTAGCCG
AACACGATTTCTTCACTTGGAAGGATGGTCGTGCAATCTATGGTAACGTTTGTAGAAAGGATCTTACCGAGTATACTATGATG
GATTTGTGTTACGCTTTACGTAACTTTGATGAAAACAATTGCGATGTTCTTAAGAGCATTTTAATTAAGGTAGGCGCTTGTGA
GGAGTCCTACTTCAATAATAAAGTCTGGTTTGACCCTGTTGAAAATGAAGACATTCATCGTGTTTATGCATTGTTAGGTACCA
TTGTTTCACGTGCTATGCTTAAATGCGTTAAGTTCTGTGATGCAATGGTTGAACAAGGTATAGTTGGTGTTGTCACATTAGAT
AATCAGGATCTTAATGGTGATTTTTATGATTTTGGTGATTTTACTTGTAGCATCAAGGGAATGGGTATACCCATTTGCACATC
ATATTACTCTTATATGATGCCTGTTATGGGTATGACTAATTGCCTTGCTAGTGAGTGTTTTGTTAAGAGTGATATATTTGGTG
AGGATTTCAAGTCATATGACCTGTTGGAATATGATTTCACGGAGCATAAGACAGCACTCTTCAACAAGTATTTCAAGTATTGG
GGACTGCAATACCACCCTAACTGTGTGGACTGCAGTGATGAGCAGTGCATAGTTCACTGTGCCAATTTCAATACGTTGTTTTC
CACTACTATACCTATTACGGCATTTGGACCTTTGTGTCGCAAGTGTTGGATTGATGGTGTTCCACTGGTAACTACAGCTGGTT
ATCATTTTAAACAGTTAGGTATAGTTTGGAACAATGACCTCAACTTACACTCTAGCAGGCTCTCTATTAACGAACTACTCCAG
TTTTGTAGTGATCCTGCATTGCTTATAGCATCATCACCAGCCCTTGTTGATCAGCGTACTGTTTGCTTTTCAGTTGCAGCGCT
AGGTACAGGTATGACTAACCAGACTGTTAAACCTGGCCATTTCAATAAGGAGTTTTATGACTTCTTACTTGAGCAAGGTTTCT
TTTCTGAGGGCTCTGAGCTTACTTTAAAGCACTTCTTCTTTGCACAGAAGGGTGATGCAGCTGTTAAGGATTTTGACTACTAT
AGGTATAATAGACCTACTGTTCTGGACATTTGCCAAGCTCGCGTCGTTTATCAAATAGTGCAACGCTATTTTGATATTTACGA
AGGTGGTTGTATCACTGCTAAAGAAGTGGTTGTTACAAACCTTAACAAGAGCGCAGGTTATCCTTTGAACAAGTTTGGTAAAG
CTGGTCTTTACTATGAGTCTTTATCCTATGAGGAACAGGATGAACTTTATGCTTATACTAAGCGTAACATCCTGCCCCACTATG
ACACAGCTCAACCTTAAATATGCTATAAGTGGCAAAGAACGTGCACGCACAGTGGGTGGTGTTTCGCTTTTGTCAACCATGAC
TACTCGGCAGTATCACCAGAAACACCTTAAGTCCATAGTTAATACTAGGGGCGCTTCGGTTGTTATTGGTACTACTAAGTTTT
ATGGTGGTTGGGACAATATGCTTAAGAACCTTATTGATGGTGTCGAAAATCCGTGTCTTATGGGTTGGGATTACCCAAAGTGC
GACAGAGCACTGCCCAATATGATACGCATGATTTCAGCCATGATTTTAGGCTCTAAGCACACCACATGCTGCAGTTCCACTGA
CCGCTTTTTCAGGTTGTGCAATGAATTGGCTCAAGTCCTTACTGAGGTTGTTTATTCTAATGGAGGTTTTTATTTGAAGCCAG
GTGGTACTACCTCTGGTGATGCAACCACCGCATATGCAAACTCAGTTTTCAATATCTTCCAAGCAGTAAGTGCCAATGTTAAC
AAACTTCTTAGTGTTGACAGCAATGTCTGTCATAATTTAGAAGTTAAGCAATTGCAGCGTAAGCTTTATGAGTGCTGTTATAG
ATCAACTACCGTGATGACCAGTTCGTCGTTGAGTATTATGGTTACTTGCGTAAACATTTTTCAATGATGATTCTTTCTGATG
ATGGCGTTGTTGTTACAACAATGACTATGCATCACTTGGTTATGTCGCTGATCTTAACGCATTCAAGGCTGTTTTGTATTAC
CAGAACAATGTCTTCATGAGCGCCTCTAAATGTTGGATCGAGCCTGACATTAATAAAGGTCCTCATGAATTTGCTCGCAGCA
TACTATGCAGATTGTCGATAAAGATGGTACTTACTACCTACCTTACCCTGATCCTTCAAGAATCCTCTCTGCAGGTGTGTTTG
TTGACGACGTTGTTAAAACTGATGCAGTTGTATTGCTTGAACGTTATGTGTCATTGGCTATAGATGCCTACCCGTTATCTAAG
CATGAAAACCCTGAATATAAGAAGGTGTTTTATGTGCTTTTGGATTGGGTTAAGCACCTGTATAAAACTTTGAATGCTGGTGT
GTTAGAGTCTTTTTCTGTCACACTTTTGGAAGATTCTACTGCTAAATTCTGGGATGAGAGCTTTTATGCCAACATGTATGAGA
AATCTGCAGTTTTGCAATCTGCAGGGCTTTGTGTTGTTTGTGGCTCTCAAACTGTTTTACGTTGTGGTGATTGTCTACGGCGT
CCTATGCTTTGTACTAAGTGTGCTTATGATCATGTCATTGGAACAACTCACAAGTTCATTTTGGCCATCACTCCATATGTGTG
TTGTGCTTCAGATTGTGGTGTCAATGATGTAACTAAGCTCTATTTAGGTGGTCTTAGTTATTGGTGTCATGACCACAAGCCAC
GTCTTGCATTCCCGTTGTGCTCTGCTGGTAATGTTTTTGGCTGTGCAAAAATTCTGCTACCGGCTCACCCGATGTTGAAGAC
TTTAATCCTATCCGATTGGACGATGTTTCTGACTACAGGTTGGCAAATGATGTCAAGGACTCATTCGTCGTCTGTT
TGCAGCGGAAACTATCAAGCCAAGGAGGAGAGCGTTAAGTCATCCTATGCTTGTGCAACACTACATGAGGTTGTAGGACCTA
AAGAGTTGTTGCTCAAATGGGAAGTCGGCAGACCCAAACCACCCCTTAATAGAAATTCGGTTTTCACTTGTTATCATATAACG
AAGAACACCCAAATTTCAAATCGGTGAGTTTGTGTTTGAGAAGGCAGAATATGATAATGATGCTGTAACATATAAAACTACCGC
CACAACAAAACTTGTTCCTGGCATGGTTTTTGTGCTTACCTCACATAATGTTCAGCCATTGCGCGCACCGACCATTGCTAACC
AAGAACGTTATTCCACTATACATAAGTTGCATCCTGCTTTTAACATACCTGAAGCTTATTCTAGCTTAGTGCCCTATTACCAA
TTGATTGGTAAGCAGAAGATTACAACTATTCAGGGACCTCCCGGTAGTGGTAAATCTCACTGTGTTATAGGGCTAGGTTTGTA
CTATCCAGGTGCACGTATAGTGTTTACAGCTTGTTCTCATGCAGCGGTCGATTCACTTTGTGTGAAAGCTTCCACTGCTTATA
```

Fig. 3B4

```
GCAATGACAAATGTTCACGCATCATACCACAGCGCGCTCGTGTTGAGTGTTATGATGGTTTCAAGTCTAATAATACTAGTGCT
CAGTACCTTTTCTCTACTGTCAATGCTTTGCCAGAGTGCAATGCGGACATTGTTGTGGTGGATGAGGTCTCTATGTGCACTAA
TTATGACTTGTCTGTCATAAATCAGCGCATCAGCTATAGGCATGTAGTCTATGTTGGTGACCCTCAACAGCTGCCTGCACCAC
GTGTTATGATTTCACGTGGTACTTTGGAACCAAAGGACTACAACGTTGTCACTCAACGCATGTGTGCCCTTAAGCCTGATGTT
TTCTTGCACAAGTGTTATCGCTGTCCTGCTGAGATAGTGCGTACTGTGTCTGAGATGGTCTATGAAAACCAATTCATTCCTGT
GCACCCAGATAGCAAGCAGTGTTTTAAAATCTTTTGCAAGGGTAATGTTCAGGTTGATAATGGTTCAAGCATTAATCGCAGGC
AATTGGATGTTGTGCGTATGTTTTTGGCTAAAAATCCTAGGTGGTCAAAGGCTGTTTTTATTTCTCCTTATAACAGCCAGAAT
TATGTTGCCAGCCGCATGCTAGGTCTACAAATTCAGACAGTTGACTCATCCCAGGGTAGTGAGTATGACTATGTCATTTACAC
ACAAACTTCAGATACTGCCCATGCCTGTAATGTTAACAGGTTTAATGTTGCCATCACAAGGGCCAAGAAAGGCATATTATGTA
TAATGTGCGATAGGTCCCTTTTTGATGTGCTTAAATTCTTTGAGCTTAAATTGTCTGATTTGCAGGCTAATGAGGGTTGTGGT
CTTTTTAAAGACTGTAGCAGAGGTGATGATCTGTTGCCACCATCTCACGCTAACACCTTCATGTCTTTAGCGGACAATTTTAA
GACTGATCAAGATCTTGCTGTTCAAATAGGTGTTAATGGACCCATTAAATATGAGCATGTTATCTCGTTTATGGGTTTCCGTT
TTGATATCAACATACCCAACCATCATACTCTCTTTTGCACACGCGACTTTGCCATGCGCAATGTTAGAGGTTGGTTAGGCTTT
GACGTTAAGGAGCACATGTTGTTGGCTCTAACGTCGGTACAAATGTCCCATTGCAATTAGGGTTTTCTAACGGTGTTGATTT
TGTTGTCAGACCTGAAGGTTGCGTGTAACAGAGTCTGGTGACTACATTAAACCCGTCAGAGCTCGTGCTCCACCAGGGGAAC
AATTCGCACACCTTTTGCCTTTACTTAAACGCGGCCAACCATGGGATGTTGTCCGCAAACGTATAGTGCAGATGTGTAGTGAC
TACCTGGCCAACCTATCAGACATACTAATTTTTGTGTTGTGGGCTGGTGGTTTGGAGTTGACAACTATGCGTTATTTTGTCAA
GATTGGACCAAGTAAGAGTTGTGATTGTGGTAAGGTTGCTACTTGTTACAATAGTGCGCTGCATACGTACTGTTGTTTCAAAC
ATGCCCTTGGTTGTGATTATCTGTATAACCCATACTGTATTGATATACAGCAGTGGGGATACAAGGGATCACTTAGCCTTAAC
CACCATGAGCATTGTAATGTACATAGAAACGAGCATGTGGCTTCGGTGATGCCATAATGACTCGCTGTCTGGCCATACATGA
TTGCTTTGTCAAGAACGTTGACTGGTCCATCACATACCCATTTATTGGTAATGAGGCTGTTATTAATAAGAGCGGCCGAATTG
TGCAATCACACACTATGCGGTCAGTTCTTAAGTTATACAATCCGAAAGCCATATATGATATTGGCAATCCTAAGGGCATTAGA
TGTGCCGTAACGGATGCTAAGTGGTTTTGCTTTGACAAGAATCCTACTAATTCTAATGTCAAGACATTGGAGTATGACTATAT
AACACATGGCCAATTTGATGGGTTGTGCTTGTTTTGGAATTGCAATGTAGACATGTATCCAGAATTTTCTGTGGTCTGTCGTT
TTGATACTCGCTGTAGGTCACCACTCAACTTGGAGGGTTGTAATGGTGGTTCACTGTATGTTAATAATCATGCATTCCATACA
CCGGCTTTTGACAAGCGTGCTTTTGCTAAGTTGAAGCCAATGCCATTTTTCTTTTATGATGATACTGAGTGTGACAAGTTACA
GGACTCCATAAACTATGTTCTCTTAGGGCTAGTAACTGCATTACTAAATGTAATGTTGGTGGTGCTGTCTGTAGTAAGCATT
GTGCTATGTATCATAGCTATGTTAATGCTTACAACACTTTTACGTCGGCGGGCTTTACTATTTGGGTGCCTACTTCGTTTGAC
ACCTATAATCTGTGGCAGACATTTAGTAACAATTTGCAAGGTCTTGAGAACATTGCTTTCAATGTCGTAAAGAAAGGATCTTT
TGTTGGTGCCGAAGGTGAACTTCCTGTAGCTGTGGTTAATGACAAAGTGCTCGTTAGAGATGGTACTGTTGATACTCTTGTTT
TTACAAACAAGACATCACTACCCACTAACGTAGCTTTTGAGTTGTATGCCAAGCGTAAGGTAGGACTCACCCCACCCATTACG
ATCCTACGTAACTTGGGTGTAGTTTGTACATCTAAGTGTGTCATTTGGGACTATGAAGCCGAACGTCCACTTACTACTTTTAC
AAAGGATGTTTGTAAATATACCGACTTTGAGGGTGACGTCTGTACACTCTTTGATAACAGCATTGTTGGTTCATTAGAGCGAT
TCTCCATGACCCAAAATGCTGTGCTTATGTCACTTACAGCTGTTAAAAAGCTTACTGGCATAAAGTTAACTTATGGTTATCTT
AATGGTGTCCCAGTTAACACACATGAAGATAAACCTTTTACTTGGTATATTTACACTAGGAAGAACGGCAAGTTCGAGGACCA
TCCTGATGGCTATTTTACCCAAGGTAGAACAACCGCTGATTTTAGCCCTCGTAGCGACATGGAAAAGGACTTCCTAAGTATGG
ATATGGGTCTGTTTATTAACAAGTACGGACTTGAAGATTACGGCTTTGAGCACGTTGTGTATGGTGATGTTTCTAAAACCACC
CTTGGTGGTTTACATCTACTAATTTCGCAGGTGCGTCTGGCCTGTATGGGTGTGCTTAAAATAGACGAGTTTGTGTCTAGTAA
TGATAGCACGTTAAAGTCTTGTACTGTTACATATGCTGATAACCCTAGTAGTAAGATGGTTTGCACGTATATGGATCTCCTTC
TTGACGATTTTGTCAGCATTCTTAAATCGTTGGATTTGAGTGTTGTATCTAAAGTTCATGAAGTTATGGTCGATTGTAAAATG
TGGAGGTGGATGTTGTGGTGTAAGGATCATAAACTCCAGACATTTTATCCGCAACTTCAGGCCAGTGAATGGAAATGTGGTTA
TTCCATGCCTTCTATTTACAAGATACAACGTATGTGTTTAGAACCTTGCAACCTCTATAACTATGGTGCTGGTATTAAGTTAC
CTGATGGCATTATGTTTAACGTAGTTAAATATACACAGCTTTGTCAATATCTTAATAGCACCACAATGTGTGTACCCCATCAC
ATGCGCGTGCTACATCTTGGTGCTGGCTCCGACAAGGGTGTTGCACCTGGCACGGCTGTCTTACGACGTTGGTTGCCACTGGA
TGCCATTATAGTTGACAATGATAGTGTGGATTACGTTAGCGATGCTGATTATAGTGTTACGGGAGATTGCTCTACCTTATACC
TGTCAGATAAGTTTGACTTAGTTATATCTGATATGTATGATGGTAAGATTAAAAGTTGTGATGGGGAGAACGTGTCTAAAGAA
GGCTTCTTTCCCTATATTAATGGTGTCATCACTGAAAAGTTGGCACTTGGTGGTACTGTAGCTATTAAGGTGACGGAGTTTAG
TTGGAATAAGAAGTTGTATGAACTCATTCAGAAGTTTGAGTATTGGACAATGTTCTGTACCAGTGTTAACACGTCATCGTCAG
AGGCATTTTTAATTGGTGTTCACTATTAGGTGATTTTGCAAGTTGGCGCTGTGATTGACGCAACACTATGCATGCCCAATTAT
ATCTTCTGGCGTAATTCCACATTATGACTATGTCTTACAATAGTGTACTTGATTAAGCAAGTTCAATTGTAAGCATAAGGC
TACAGTTGTTATTAATTAAAAGATTCATCCATTAGTGATGTTGTGTTAGGTTTGTTGAAGAATGGTAAGTTGCTAGTGCGTA
ATAATGACGCCATTTGTGGTTTTTCTAATCATTTGGTCAACGTAAACAAATGAAGTCTTTAAATTACTTCTGGTTGTTCTTAC
CAGTACTTTCAACACTCAGCCTACCACAAGATGTCACTAGGTGCCAGTCCACTATTAACTTCAGGCGGTTCTTTTCAAAATTT
AATGTGCAGGCACCTGCTGTCGTTGTGTTGGGTGGTTATCTACCTAGTATGAACTCCTCTAGCTGGTACTGTGGCACAGGTCT
TGAAACTGCTAGTGGCGTGCATGGTATTTTCCTCAGTTACATCGATGCTGGTCAGGCTTTGAGATTGGCATTTCACAGGAGC
CGTTTGATCCTAGTGGTTACCAGCTTTATTTACATAAGGCCACTAATGGTAACCATAATGCTATTGCACGACTGCGCATTTGC
CAGTTTCCAGATAATAAAACATTGGGCCCTACTGTTAATGATGTTACAACAGGTCGTAACTGCCTATTCAACAAAGCCATTCC
AGCTTATATGCAGGATGGAAAAAATATCGTTGTCGGCATAACATGGGACAATGATCGTGTCACTGTTTTTGCTGACAAGATCT
ATCATTTTTATCTTAAAAATGATTGGTCCCGTGTTGCGACAAGATGTTACAATAAAGAAGTTGTGCTATGCAATATGTTTAT
```

Fig. 3B5

```
ACACCTACCTACTACATGCTTAATGTTACTAGTGCAGGTGAGGATGGCATTTATTATGAACCATGTACAGCTAATTGCAGTGG
TTACGCTGCCAATGTGTTTGCCACTGATTCTAATGGCCACATACCAGAAGGTTTTAGTTTTAATAATTGGTTTCTTTTGTCCA
ATGATTCCACTTTGTTGCATGGTAAGGTGGTTTCCAACCAACCTTTGTTGGTCAATTGTCTTTTGGCCATTCCTAAGATTTAT
GGACTAGGCCAATTTTTCTCATTCAATCAAACGATGGATGGCGTTTGTAATGGAGCTGCTGCGCAGCGTGCACCAGAGGCTCT
GAGGTTTAATATTAATGACACCTCTGCTCATTCTTGCTGAAGGCTCAATTGTACTTCATACTGCTTTAGGAACAAATCTTTCTT
TTGCTTGCAGTAATTCTTCAGATCCTCATCTAGCTACCTTCGCCATACCTCTGGGTGCTACCCAAGTACCTTATTATTGTTTT
CTTAAAGTGGATACTTACAACTCCACTGTTTATAAATTTTTGGCTGTTTTACCTCCTACCGTCAGGGAAATTGTCATCACCAA
GTATGGTGATGTTTATGTCAATGGGTTTGGATACTTGCATCTCGGTTTGTTGGATGCTGTCACAATTAATTTCACTGGTCATG
GCACTGACGATGATGTTTCTGGTTTTTGGACCATAGCATCGACTAATTTTGTTGATGCACTCATCGAAGTTCAAGGAACCGCC
ATTCAGCGTATTCTTTATTGTGATGATCCTGTTAGCCAACTCAAGTGTTCTCAGGTTGCTTTTGACCTTGACGATGGTTTTTA
CCCTATTTCTTCTAGAAACCTTCTGAGTCATGAACAGCCAATTTCTTTTGTTACTCTGCCATCATTTAATGATCATTCTTTTG
TTAACATTACTGTATCTGCTTCCTTTGGTGGTCATAGTGGTGCCAACCTTATTGCATCTGACACTACTATCAATGGGTTTAGT
TCTTTCTGTGTTGACACTAGACAATTTACCATTTCACTGTTTTATAACGTTACAAACAGTTATGGTTATGTGTCTAAATCACA
GGACAGTAATTGCCCTTTCACCTTGCAATCTGTTAATGATTACCTGTCTTTTAGCAAATTTTGTGTTTCCACCAGCCTTTTGG
CTAGTGCCTGTACCATAGATCTTTTGGTTACCCTGAGTTTGGTAGTGGTGTTAAGTTTACGTCCCTTTACTTTCAATTCACA
AAGGGTGAGTTGATTACTGGCACGCCTAAACCACTTGAAGGTGTCACGGACGTTTCTTCTATGACTCTGGATGTGTGTACCAA
GTATACTATCTATGGCTTTAAAGGTGAGGGTATCATTACCCTTACAAATTCTAGCTTTTTGGCAGGTGTTTATTACACATCTG
ATTCTGGACAGTTGTTAGCCTTTAAGAATGTCACTAGTGGTGCTGTTTATTCTGTTACGCCATGTTCTTTTTCAGAGCAGGCT
GCATATGTTGATGATGATATAGTGGGTGTTATTTCTAGTTTGTCTAGCTCCACTTTTAACAGTACTAGGGAGTTGCCTGGTTT
CTTCTACCATTCTAATGATGGCTCTAATTGTACAGAGCCTGTGTTGGTGTATAGTAACATAGGTGTTTGTAAATCTGGCAGTA
TTGGCTACGTCCCATCTCAGTCTGGTCAAGTCAAGATTGCACCCACGGTTACTGGGAATATTAGTATTCCCACCAACTTTAGT
ATGAGTATTAGGACAGAATATTTACAGCTTTACAACACGCCTGTTAGTGTTGATTGTGCCACATATGTTTGTAATGGTAACTC
TCGTTGTAAACAATTACTCACCCAGTACACTGCAGCATGTAAGACCATAGAGTCAGCATTACAACTCAGCGCTAGGCTTGAGT
CTGTTGAAGTTAACTCTATGCTTACTATTTCTGAAGAGGCTCTACAGTTAGCTACCATTAGTTCGTTTAATGGTGATGGATAT
AATTTTACTAATGTGCTGGGTGTTTCTGTGTATGATCCTGCAAGTGGCAGGGTGGTACAAAAAAGGTCTTTTATTGAAGACCT
GCTTTTTAATAAAGTGGTTACTAATGGCCTTGGTACTGTTGATGAAGACTATAAGCGCTGTTCTAATGGTCGCTCTGTGGCAG
ATCTAGTCTGTGCACAGTATTACTCGGTGTCATGGTACTACCTGGTGTTGTTGACGCTGAGAAGCTTCACATGTATATGCG
TCTCTCATCGGTGGTATGGTGCTAGGAGGTTTTACTTCTGCAGCGGCATTGCCTTTTAGCTATGCTGTTCAAGCTAGACTCAA
TTATCTTGCTCTACAGACGGATGTTCTACAGCGGAACCAGCAATTGCTTGCTGAGTCTTTTAACTCTGCTATTGGTAATATAA
CTTCAGCCTTTGAGAGTGTTAAAGAGGCTATTAGTCAAACTTCCAAGGGGTTTGAACACTGTGGCTCATGCGCTTACTAAGGTT
CAAGAGGTTGTTAACTCGCAGGGTGCAGCTTTGACTCAACTTACCGTACAGCTGCAACACAAACTTCCAAGCCATTTCTAGTTC
TATTGATGACATTTACTCTCGACTGGACATTCTTTCAGCCGATGTTCAGGTTGACCGTCTCATCACCGGCAGATTATCAGCAC
TTAATGCTTTTGTTGCTCAAAACCCTCACTAAGTATACTGAGGTTCAGGCTAGCAGGAAGTTAGCACAGCAAAAGGTTAATGAG
TGCGTTAAATCGCAATCTCAGCGTTATGGTTTTTGTGGTGGTGATGGCGAGCACATTTTCTCTCTGGTACAGGCAGCACCTCA
GGGCCTGCTGTTTTTACATACAGTACTTGTACCGAGTGATTTTGTAGATGTTATTGCCATCGCTGGCTTATGCGTTAACGATG
AAATTGCCTTGACTCTACGTGAGCCTGGCTTAGTCTTGTTTACGCATGAACTTCAAAATCATACTGCGACGGAATATTTTGTT
TCATCGCGACGTATGTTTGAACCTAGAAAACCTACCGTTAGTGATTTTGTTCAAATTGAGAGTTGTGTGGTCACCTATGTCAA
TTTGACTAGAGACCAACTACCAGATGTAATCCCAGATTACATCGATGTTAACAAAACACTTGATGAGATTTTAGCTTCTCTGC
CCAATAGAACTGGTCCAAGTCTTCCTTTAGATGTTTTTAATGCCATTTATCTTAATCTCACTGGTGAAATTGCAGATTTAGAG
CAGCGTTCAGAGTCTCTCCGTAATACTACAGAGGAGCTTCAAAGTCTTATATATAATATCAACAACACACTAGTTGACCTTGA
GTGGCTCAACCGAGTTGAGACATATATCAAGTGGCCGTGGTGGGTTTGGTTGATTATTTCATTGTTCTCATCTTTGTTGTGT
CATTACTAGTGTTCTGCTGCATTTCCACGGGTTGTTGTGGATGCTGCGGCTGCTGCTGTGCTTGTTTCTCAGGTTGTTGTAGG
GGTCCTAGACTTCAACCTTACGAAGTTTTTGAAAAGGTCCACGTGCAGTGATGTTTCTTGGACTTTTTCAATACACGATTGAC
ACAGTTGTCAAAGATGTCTCAAAGTCTGCTAACTTGTCTTTGGATGCTGTCCAAGAGTTGGAGCTCAATGTAGTTCCAATTAG
ACAAGCTTCAAATGTGACGGGTTTTCTTTTCACCAGTGTTTTATCTACTTCTTTGCACTGTTTAAAGCGTCTTCTTTGAGGC
GCAATTATATTATGTTGGCAGCGCGTTTTGCTGTCATTGTTCTTATTGCCCACTTTTATATTATTGTGGTGCATTTTTAGAT
GCAACTATTATTTGTTGCACACTTATTGGCAGGCTTTGTTAGTCTGCTTTTACTCCTGGCGCTATAAAAATGCGCTCTTTAT
TATTTTAATACTACGACACTTTCTTTCCTCAATGGTAAAGCAGCTTATTATGACGGCAAATCCATTGTGATTTTAGAAGGTG
GTGACCATTACATCACTTTTGGCAACCCTTTGTTGCTTTTGTTAGTAGCATGATCGTATCTAGCTATACGTGGGCGGCAA
GAAGCTGACCTACACTGTTGCGAACTGTTGAGCTTCTTGATGCAAGAAGCTTTATGTCTTTTCGCAACATCAAATTGTTGG
CATTACTAATGCTGCATTTGACTCAATTCAACTAGACGAGTATGCTACAATTAGTGAATGATAATGGTCTAGTAGTTAATGTT
ATACTTTGGCTTTTCGTACTCTTTTTCCTGCTTATTATAAGCATTACTTTCGTCCAATTGGTTAATCTGTGCTTCACTTGTCA
CCGGTTGTGTAATAGCGCAGTTTACACACCTATAGGGCGTTTGTATAGAGTTTATAAGTCTTACATGCAAATAGACCCCCTCC
CTAGTACTGTTATTGACGTATAAACGAAATATGTCTAACGGTTCTATTCCCGTTGATGAGGTGATTCAACACCTTAGAAACTG
GAATTTCACATGGAATATCATACTGACGATACTACTTGTAGTGCTTCAGTATGGCCATTACAAGTACTCTGCGTTCTTGTATG
GTGTCAAGATGGCTATTCTATGGATACTTTGGCCTCTTGTGTTAGCACTGTCACTTTTTGATGCATGGGCTAGCTTTCAGGTC
AATTGGGTCTTTTTGCTTTCAGCATCCTTATGGCTTGCATCACTCTTATGCTGTGGATAATGTACTTTGTCAATAGCATTCG
GTTGTGGCGCAGGACACATTCTTGGTGGTCTTTCAATCCTGAAACAGACGCGCTTCTCACTACTTCTGTGATGGGCCGACAGG
TCTGCATTCCAGTGCTTGGAGCACCAACTGGTGTAACGCTAACACTCCTTAGTGGTACATTGCTTGTAGAGGGCTATAAGGTT
```

Fig. 3B6

```
GCTACTGGCGTACAGGTAAGTCAATTACCTAATTTCGTCACAGTCGCCAAGGCCACTACAACAATTGTCTACGGACGTGTTGG
TCGTTCAGTCAATGCTTCATCTGGCACTGGTTGGGCTTTCTATGTCCGGTCCAAACACGGCGACTACTCAGCTGTGAGTAATC
CGAGTTCGGTTCTCACAGATAGTGAGAAAGTGCTTCATTTAGTCTAAACAGAAACTTTATGGCTTCTGTCAGTTTTCAGGATC
GTGGCCGCAAACGGGTGCCATTATCCCTCTATGCCCCTCTTAGGGTTACTAATGACAAACCCCTTTCTAAGGTACTTGCAAAT
AATGCTGTACCCACTAATAAAGGAAATAAGGACCAGCAAATTGGATACTGGACTGAGCAAATTCGCTGGCGCATGCGCCGTGG
TGAGCGAATTGAACAACCTTCCAATTGGCATTTCTACTACCTCGGAACAGGACCTCACGCCGACCTCCGCTATAGGACTCGTA
CTGAGGGTGTTTTCTGGGTTGCTAAAGAAGGCGCAAAGACTGAACCCACTAACCTGGGTGTCAGAAAGGCGTCTGAAAAGCCA
ATTATTCCAAATTTCTCTCAACAGCTTCCCAGCGTAGTTGAGATTGTTGAACCTAACACACCTCCTACTTCACGTGCAAATTC
ACGTAGCAGGAGTCGTGGTAATGGCAACAACAGGTCCAGATCTCCAAGTAACAATAGAGGCAATAACCAGTCCCGCGGTAATT
CACAGAATCGTGGAAATAACCAGGGTCGTGGAGCTTCTCAGAACAGAGGAGGCAATAATAATAACAATAACAAGTCTCGTAAC
CAGTCCAAGAACAGAAACCAGTCAAATGACCGTGGTGGTGTAACATCACGCGATGATCTGGTGGCTGCTGTCAAGGATGCCCT
TAAATCTTTGGGTATTGGCGAAAACCCTGACAAGCTTAAGCAACAGCAGAAGCCCAAACAGGAAAGGTCTGACAGCAGCGGCA
AAAATACACCTAAGAAGAACAAATCCAGAGCCACTTCGAAAGAACGTGACCTCAAAGACATCCCAGAGTGGAGGAGAATTCCC
AAGGGCGAAAATAGCGTAGCAGCTTGCTTCGGACCCAGGGGAGGCTTCAAAAATTTTGGAGATGCGGAATTTGTCGAAAAAGG
TGTTGATGCCTCAGGCTATGCTCAGATCGCCAGTTTAGCACCGAATGTTGCAGCATTGCTCTTTGGTGGTAATGTGGCTGTTC
GTGAGCTAGCGGACTCTTACGAGATTACATATAATTATAAAATGACTGTGCCAAAGTCTGATCCAAATGTAGAGCTTCTTGTT
TCACAGGTGGATGCATTTAAAACTGGGAATGCAAAACCCCAGAGAAAGAAGGAAAAGAAGAACAAGCGTGAAACCACGCAGCA
GCTGAATGAAGAGGCCATCTACGATGATGTGGGTGTGCCATCTGATGTGACTCATGCCAATTTGGAATGGGACACAGCTGTTG
ATGGTGGTGACACGGCCGTTGAAATTATCAACGAGATCTTCGACACAGGAAATTAAACAATGTTTGACTGGCTTATCCTGGCT
ATGTCCCAGGGTAGTGCCATTACACTGTTATTACTGAGTGTTTTCTAGCGACTTGGCTGCTGGGCTATGGCTTTGCCCTCTA
ACTAGCGGTCTTGGTCTTGCACACAACGGTAAGCCAGTGGTAATGTCAGTGCAAGAAGGATATTACCATAGCACTGTCATGAG
GGGAACGCAGTACCTTTTCATCTAAACCTTTGCACGAGTAATCAAAGATCCGCTTGACGAGCCTATATGGAAGAGCGTGCCAG
GTATTTGACTCAAGGACTGTTAGTAACTGAAGACCTGACGGTGTTGATATGGATACAC
```

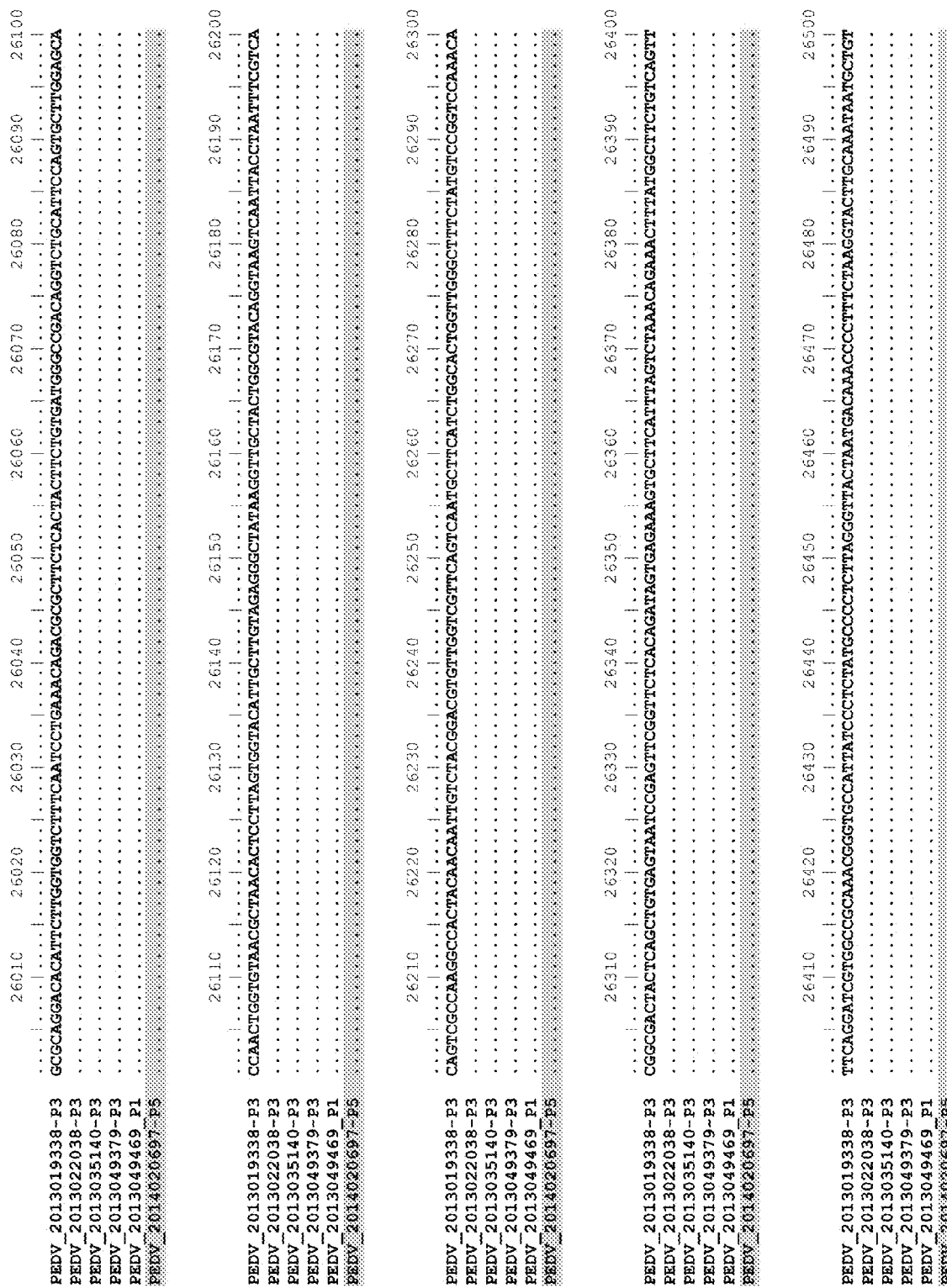
Fig. 5AAA

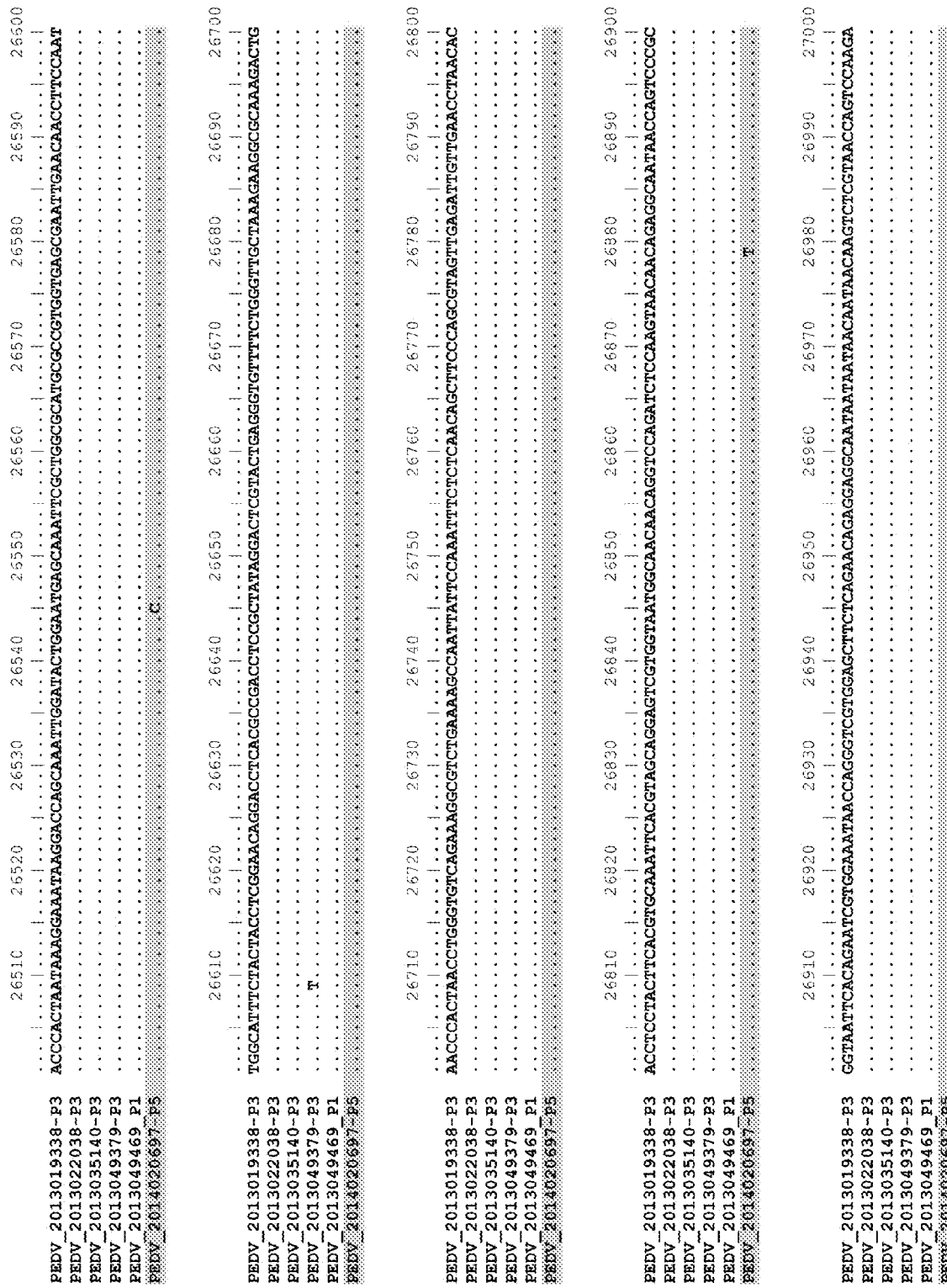
Fig. 5BBB

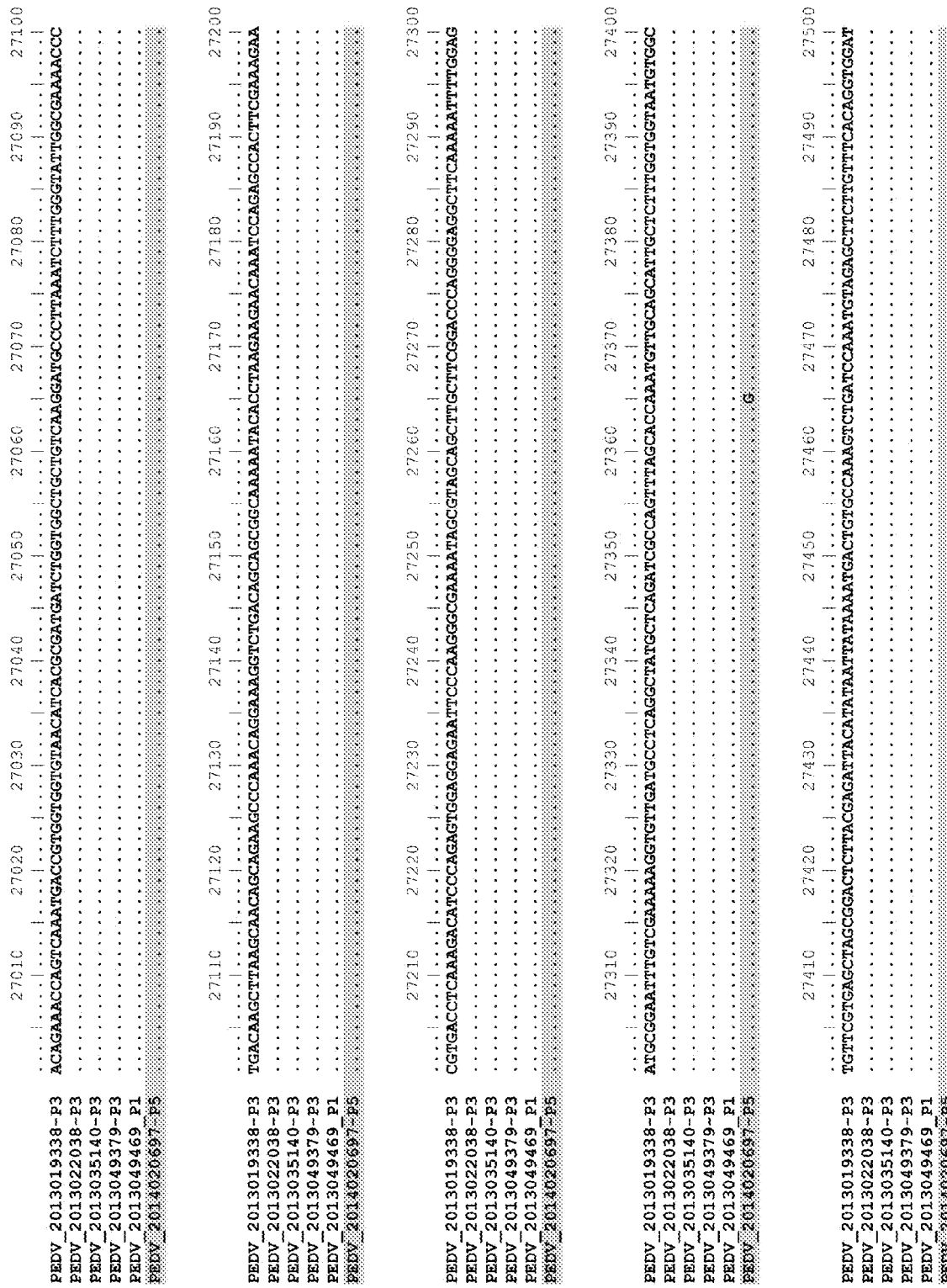
Fig. 5CCC

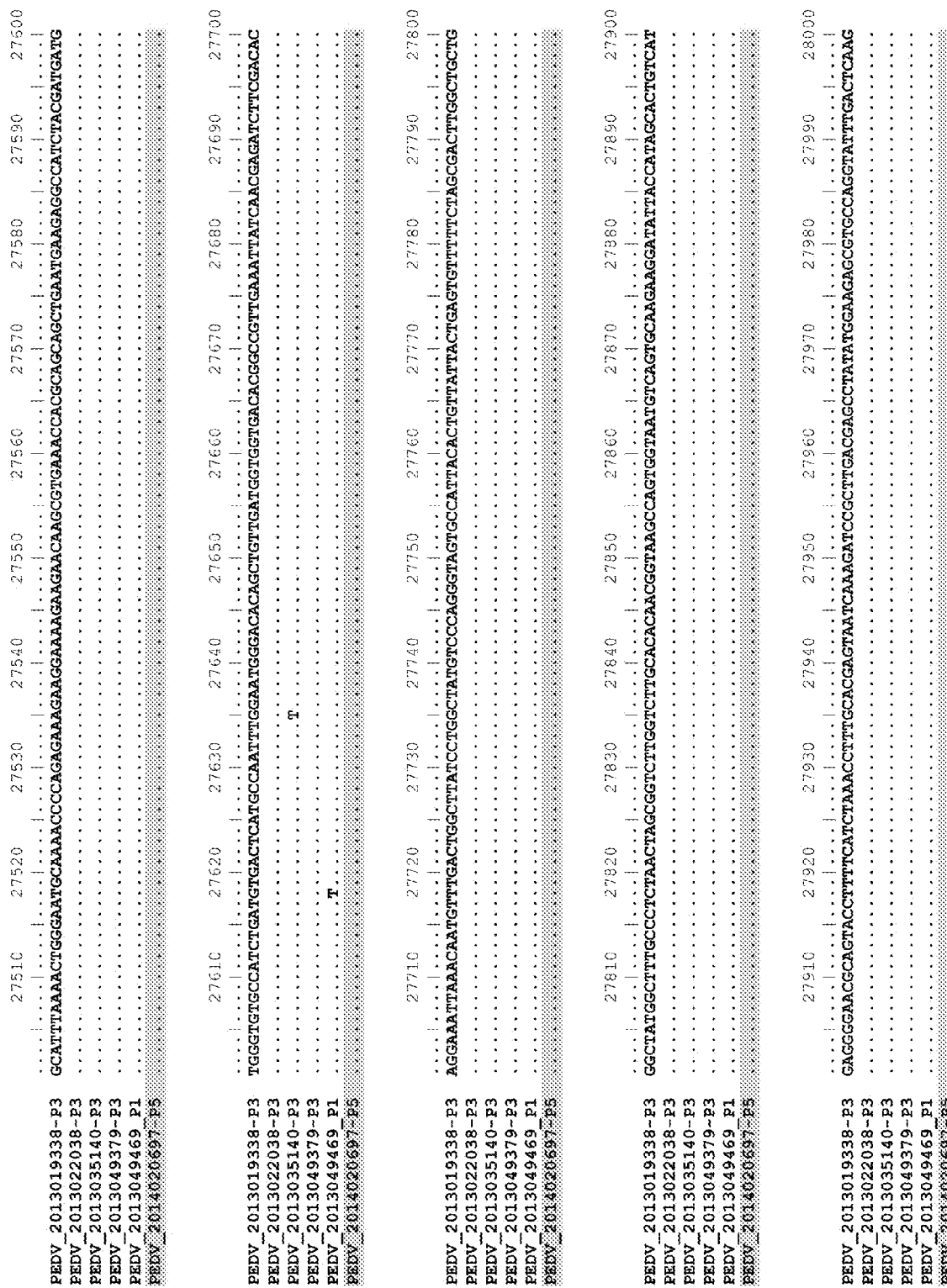
Fig. 5DDD

```
                               28010     28020     28030     28040
                           ....|....|....|....|....|....|....|....|....
PEDV_2013019338-P3   GACTGTTAGTAACTGAAGACCTGACGGTGTTGATATGGATACAC   (SEQ ID NO:9)
PEDV_2013022038-P3   ............................................   (SEQ ID NO:10)
PEDV_2013035140-P3   ............................................   (SEQ ID NO:11)
PEDV_2013049379-P3   ............................................   (SEQ ID NO:12)
PEDV_2013049469_P1   ............................................   (SEQ ID NO:13)
PEDV_2014020697-P5   ............................................   (SEQ ID NO:8)
```

Fig. 5EEE

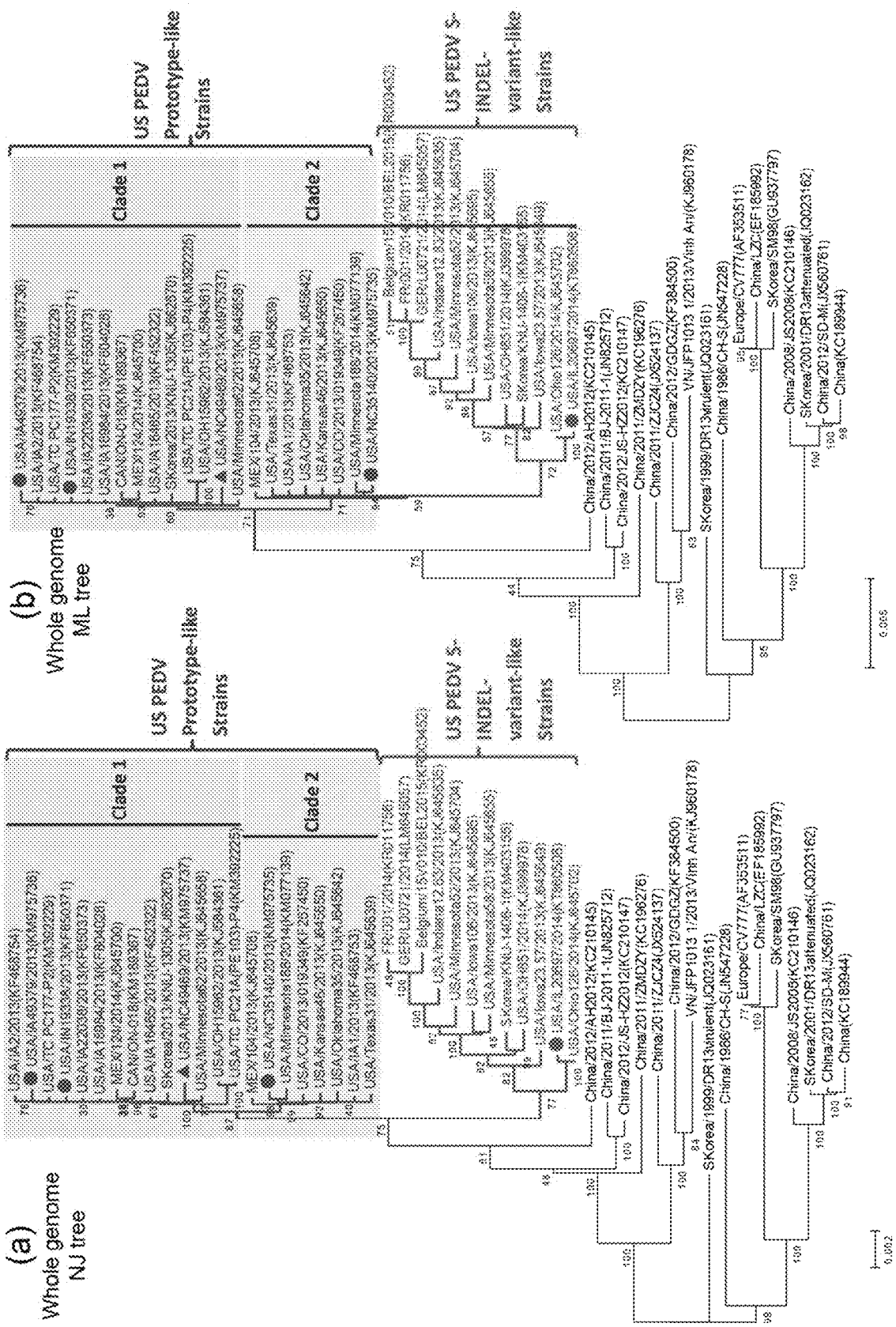
Fig. 6A (a) Whole genome NJ tree
Fig. 6B (b) Whole genome ML tree (c) S1 NJ tree (d) S1 ML tree

Fig. 8
(a) Tissue Content Scores
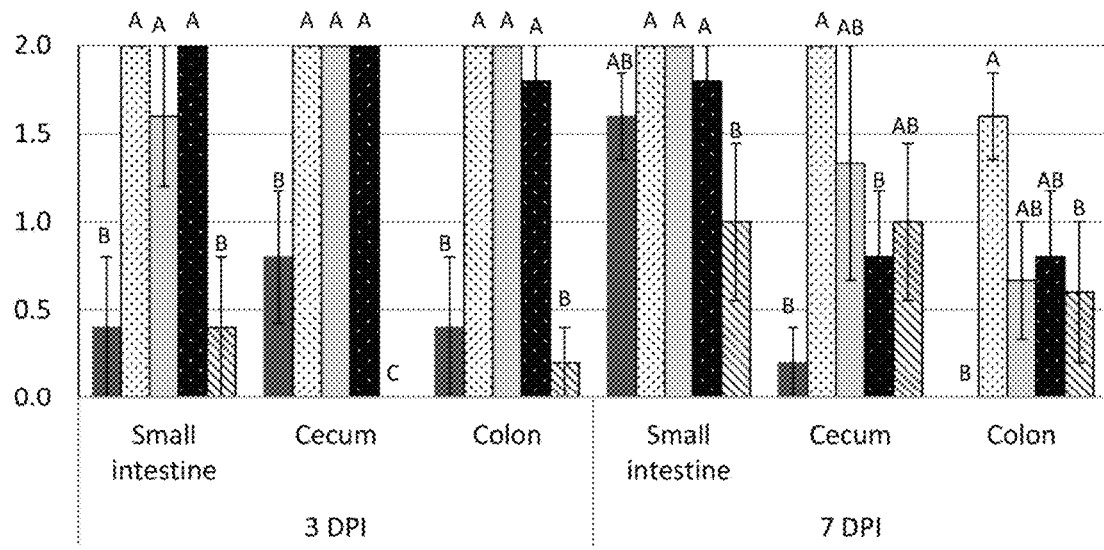
(b) Tissue Lesion Scores
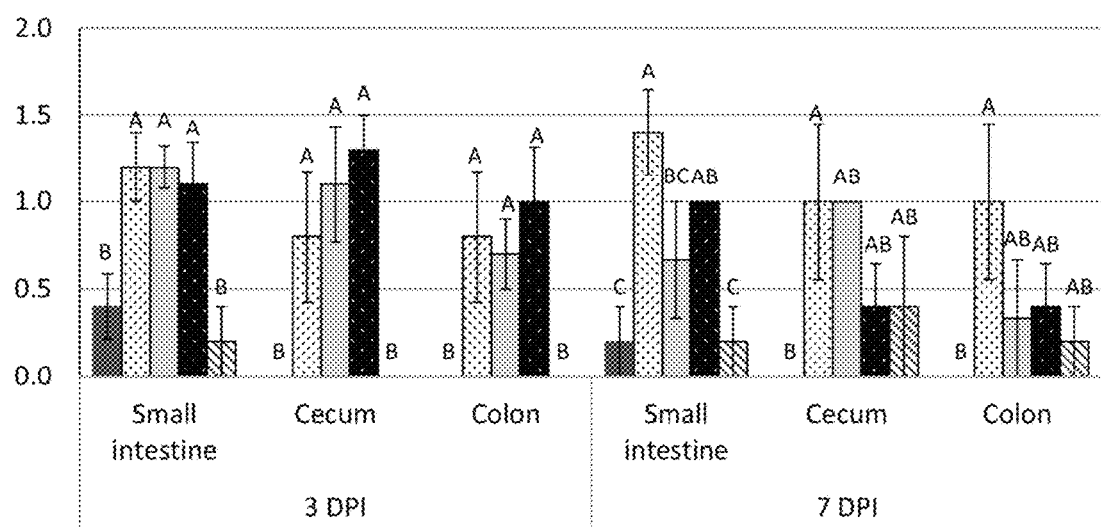

Fig. 11
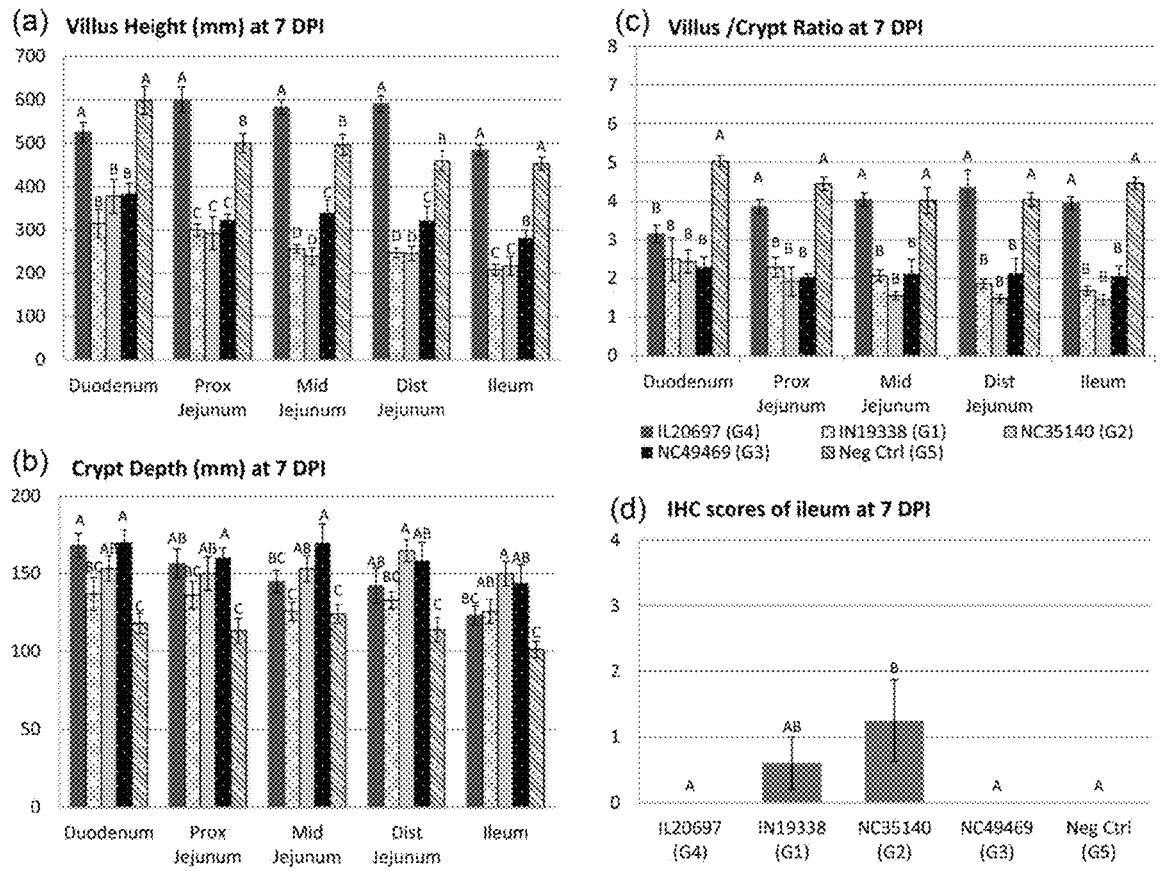
Fig. 12 Schematic diagrams of PEDV genome organization and putative functions of viral proteins
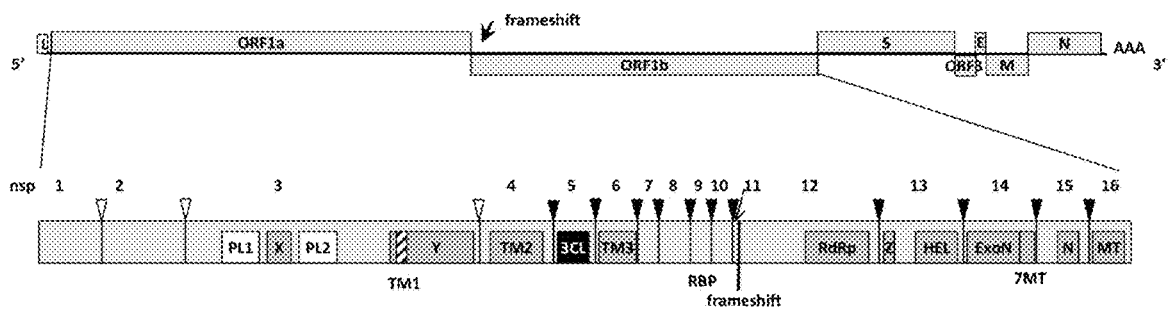

Fig. 16

Fig.22A1 USA/IL/2014/20697-P8R1 passage 8 ORF1a/1b polyprotein (SEQ ID NO: 17)

MASNHVTLAFANDAEISAFGFCTASEAVSYYSEAAASGFMQCRFVSFDLADTVEGLLPEDYVMVVVGTTKLSAYVDTFGS
RPKNICGWLLFSNCNYFLEELELTFGRRGGNIVPVDQYMCGADGKPVLQESEWEYTDFFADSEDGQLNIAGITYVKAWIV
ERSDVSYASQNLTSIKSITYCSTYEHTFPDGTAMKVARTPKIKKTVVLSEPLATIYREIGSPFVDNGSDARSIIKRPVFL
HAFVKCKCGSYHWTVGDWTSYVSTCCGFKCKPVLVASCSATPGSVVVTRAGAGTGVKYYNNMFLRHVADIDGLAFWRILK
VQSKDDLACSGKFLEHHEEGFTDPCYFLNDSSIATKLKFDILSGKFSDEVKQAIFAGHVVVGSALVDIVDDALGQPWFIR
KLGDLASAAWEQLKAVVRGLNLLSDEVVLFGKRLSCATLSIVNGVFEFIAEVPEKLAAAVTVFVNFLNELFESACDCLKV
GGKTFNKVGSYVLFDNALVKLVKAKVRGPRQAGVCEVRYTSLVIGSTTKVVSKRVENANVNLVVVDEDATLNTTGRTVVV
DGLAFFESDGFYRHLADADVVIEHPVYKSACELKPVFECDPIPDFPMPVAASVAELCVQTDLLLKNYNTPYKTYSCVVRG
DKCCITCTLHFTAPSYMEAAANFVDLCTKNIGTAGFHEFYITAHEQQDLQGFVTTCCTMSGFECFMPIIPQCPAVLEEID
GGSIWRSFITGLNTMWDFCKHLKVSFGLDGIVVTVARKFKRLGALLAEMYNTYLSTVVENLVLAGVSFKYYATSVPKIVL
GCCFHSVKSVLASAFQIPVQAGVEKFKVFLNCVHPVVPRVIETSFVELEETTFKPPALNGSIAIVDGFAFYYDGTLYYPT
DGNSVVPICFKKKGGGDVKFSDEVSVKTIDPVYKVSLEFEFESETIMAVLNKAVGNCIKVTGGWDDVVEYINVAIEVLKD
HIDVPKYYIYDEEGGTDPNLPVMVSQWPLNDDTISQDLLDVEVVTDAPVDFEGDEVDSSDPDKVADVANSEPEDDGLNVA
PETNVESEVEEVAATLSFIKDTPSTVTKDPFAFDFASYGGLKVLRQSHNNCWVTSTLVQLQLLGIVDDPAMELFSAGRVG
PMVRKCYESQKAILGSLGDVSACLESLTKDLHTLKITCSVVCGCGTGERIYDGCAFRMTPTLEPFPYGACAQCAQVLMHT
FKSIVGTGIFCRDTTALSLDSLVVKPLCAAAFIGKDSGHYVTNFYDAAMAIDGYGRHQIKYDTLNTICVKDVNWTAPFVP
DVEPVLEPVVKPFYSYKNVDFYQGDFSDLVKLPCDFVVNAANENLSHGGGIAKAIDVYTRGMLQKCSNDYIKAHGPIKVG
RGVMLEALGLKVFNVVGPRKGKHAPELLVKAYKSVFANSGVALTPLISVGIFSVPLEESLSAFLACVGDRHCKCFCYSDK
EREAIINYMDGLVDAIFKDALVDTTPVQEDVQQVSQKPVLPNFEPFRIEGAHAFYECNPEGLMSLGADKLVLFTNSNLDF
CSVGKCLNNVTGGALLEAINVFKKSNKTVPAGNCVTFECADMISITMVVLPSDGDANYDKNYARAVVKVSKLKGKLLLAV
GDAMLYSKLSHLSVLGFVSTPDDVERFYANKSVVIKVTEDTRSVKTVKVESTVTYGQQIGPCLVNDTVVTDNKPVVADVV
AKVVPSANWDSHYGFDKAGEFHMLDHTGFAFPSEVVNGRRVLKTTDNNCWVNVTCLQLQFARFRFKSAGLQAMWESYCTG
DVAMFVHWLYWLTGVDKGQPSDSENALNMLSKYIVPAGSVTIERVTHDGCCCSKRVVTAPVVNASVLKLGVEDGLCPHGL
NYIDKVVVVKGTTIVVNVGKPVVAPSHLFLKGVSYTTFLDNGNGVAGHYTVFDHDTGMVHDGDVFVPGDLNVSPVTNVVV
SEQTAVVIKDPVKKVELDATKLLDTMNYASERFFSFGDFMSRNLITVFLYILSILGLCFRAFRKRDVKVLAGVPQRTGII
LRKSVRYNAKALGVFFKLKLYWFKVLGKFSLGIYALYALLFMTIRFTPIGGPVCDDVVAGYANSSFDKNEYCNSVICKVC
LYGYQELSDFSHTQVVWQHLRDPLIGNVMPFFYLAFLAIFGGVYVKAITLYFIFQYLNILGVFLGLQQSIWFLQLVPFDV
FGDEIVVFFIVTRVLMFLKHVFLGCDKASCVACSKSARLKRVPVQTIFQGTSKSFYVHANGGSKFCKKHNFFCLNCDSYG
PGCTFINDVIATEVGNVVKLNVQPTGPATILIDKVEFSNGFYYLYSGDTFWKYNFDITDNKYTCKESLKNCSIITDFIVF
NNNGSNVNQVKNACVYFSQMLCKPVKLVDSALLASLSVDFGASLHSAFVSVLSNSFGKDLSSCNDMQDCKSTLGFDDVPL
DTFNAAVAEAHRYDVLLTDMSFNNFTTSYAKPEEKLPVHDIATCMRVGAKIVNHNVLVKDSIPVVWLVRDFIALSEETRK
YIIRTTKVKGITFMLTFNDCRMHTTIPTVCIANKKGAGLPSFSKVKKFFWFLCLFIVAVFFALSFFDFSTQVSSDSDYDF
KYIESGQLKTFDNPLSCVHNVFSNFDQWHDAKFGFTPVNNPSCPIVVGVSDEARTVPGIPAGVYLAGKTLVFAINTIFGT
SGLCFDASGVADKGACIFNSACTTLSGLGGTAVYCYKNGLVEGAKLYSELAPHSYYKMVDGNTVSLPEIISRGFGIRTIR
TKAMTYCRVGQCVQSAEGVCFGADRFFVYNAESGSDFVCGTGLFTLLMNVISVFSKTVPVTVLSGQILFNCIIAFAAVAV
CFLFTKFKRMFGDMSVGVFTVGACTLLNNVSYIVTQNTLGMLGYATLYFLCTKGVRYMWIWHLGFLISYILIAPWWVLMV
YAFSAIFEFMPNLFKLKVSTQLFEGDKFVGSFENAAAGTFVLDMHAYERLANSISTEKLRQYASTYNKYKYYSGSASEAD
YRLACFAHLAKAMMDYASNHNDTLYTPPTVSYNSTLQAGLRKMAQPSGVVEKCIVRVCYGNMALNGLWLGDTVICPRHVI
ASSTTSTIDYDYALSVLRLHNFSISSGNVFLGVVGVTMRGALLQIKVNQNNVHTPKYTYRTVRPGESFNILACYDGSAAG
VYGVNMRSNYTIRGSFINGACGSPGYNINNGTVEFCYLHQLELGSGCHVGSDLDGVMYGGYEDQPTLQVEGASSLFTENV
LAFLYAALINGSTWWLSSSRIAVDRFNEWAVHNGMTTVVNTDCFSILAAKTGVDVQRLLASIQSLHKNFGGKQILGYTSL
TDEFTTGEVIRQMYGVNLQSGYVSRACRNVLLVGSFLTFFWSELVSYTKFFWVNPGYVTPMFACLSLLSSLLMFTLKHKT
LFFQVFLIPALIVTSCINLAFDVEVYNYLAEHFDYHVSLMGFNAQGLVNIFVCFVVTILHGTYTWRFFNTPVSSVTYVVA
LLTAAYNYFYASDILSCAMTLFASVTGNWFVGAVCYKAAVYMALRFPTFVAIFGDIKSVMFCYLVLGYFTCCFYGILYWF
NRFFKVSVGVYDYTVSAAEFKYMVANGLRAPTGTLDSLLLSAKLIGIGGERNIKISSVQSKLTDIKCSNVVLLGCLSSMN
VSANSTEWAYCVDLHNKINLCNDPEKAQEMLLALLAFFLSKNSAFGLDDLLESYFNDNSMLQSVASTYVGLPSYVIYENA
RQQYEDAVNNGSPPQLVKQLRHAMNVAKSEFDREASTQRKLDRMAEQAAAQMYKEARAVNRKSKVVSAMHSLLFGMLRRL
DMSSVDTILNLAKDGVVPLSVIPAVSATKLNIVTSDIDSYNRIQREGCVHYAGTIWNIIDIKDNDGKVVHVKEVTAQNAE
SLSWPLVLGCERIVKLQNNEIIPGKLKQRSIKAEGDGIVGEGKALYNNEGGRTFMYAFISDKPDLRVVKWEFDGGCNTIE
LEPPRKFLVDSPNGAQIKYLYFVRNLNTLRRGAVLGYIGATVRLQAGKQTEQAINSSLLTLCAFAVDPAKTYIDAVKSGH
KPVGNCVKMLANGSGNGQAVTNGVEASTNQDSYGGASVCLYCRAHVEHPSMDGFCRLKGKYVQVPLGTVDPIRFVLENDV
CKVCGCWLANGCTCDRSIMQSTDMAYLNRVRGSSAARLEPCNGTDTQHVYRAFDIYNKDVACLGKFLKVNCVRLKNLDKH
DAFYVVKRCTKSAMEHEQSIYSRLEKCGAVAEHDFFTWKDGRAIYGNVCRKDLTEYTMMDLCYALRNFDENNCDVLKSIL
IKVGACEESYFNNKVWFDPVENEDIHRVYALLGTIVSRAMLKCVKFCDAMVEQGIVGVVTLDNQDLNGDFYDFGDFTCSI

KGMGIPICTSYYSYMMPVMGMTNCLASECFVKSDIFGEDFKSYDLLEYDFTEHKTALFNKYFKYWGLQYHPNCVDCSDEQ
CIVHCANFNTLFSTTIPITAFGPLCRKCWIDGVPLVTTAGYHFKQLGIVWNNDLNLHSSRLSINELLQFCSDPALLIASS
PALVDQRTVCFSVAALGTGMTNQTVKPGHFNKEFYDFLLEQGFFSEGSELTLKHFFFAQKGDAAVKDFDYYRYNRPTVLD
ICQARVVYQIVQRYFDIYEGGCITAKEVVVTNLNKSAGYPLNKFGKAGLYYESLSYEEQDELYAYTKRNILPTMTQLNLK
YAISGKERARTVGGVSLLSTMTTRQYHQKHLKSIVNTRGASVVIGTTKFYGGWDNMLKNLIDGVENPCLMGWDYPKCDRA
LPNMIRMISAMILGSKHTTCCSSTDRFFRLCNELAQVLTEVVYSNGGFYLKPGGTTSGDATTAYANSVFNIFQAVSANVN
KLLSVDSNVCHNLEVKQLQRKLYECCYRSTTVDDQFVVEYYGYLRKHFSMMILSDDGVVCYNNDYASLGYVADLNAFKAV
LYYQNNVFMSASKCWIEPDINKGPHEFCSQHTMQIVDKDGTYYLPYPDPSRILSAGVFVDDVVKTDAVVLLERYVSLAID
AYPLSKHENPEYKKVFYVLLDWVKHLYKTLNAGVLESFSVTLLEDSTAKFWDESFYANMYEKSAVLQSAGLCVVCGSQTV
LRCGDCLRRPMLCTKCAYDHVIGTTHKFILAITPYVCCASDCGVNDVTKLYLGGLSYWCHDHKPRLAFPLCSAGNVFGLY
KNSATGSPDVEDFNRIATSDWTDVSDYRLANDVKDSLRLFAAETIKAKEESVKSSYACATLHEVVGPKELLLKWEVGRPK
PPLNRNSVFTCYHITKNTKFQIGEFVFEKAEYDNDAVTYKTTATTKLVPGMVFVLTSHNVQPLRAPTIANQERYSTIHKL
HPAFNIPEAYSSLVPYYQLIGKQKITTIQGPPGSGKSHCVIGLGLYYPGARIVFTACSHAAVDSLCVKASTAYSNDKCSR
IIPQRARVECYDGFKSNNTSAQYLFSTVNALPECNADIVVVDEVSMCTNYDLSVINQRISYRHVVYVGDPQQLPAPRVMI
SRGTLEPKDYNVVTQRMCALKPDVFLHKCYRCPAEIVRTVSEMVYENQFIPVHPDSKQCFKIFCKGNVQVDNGSSINRRQ
LDVVRMFLAKNPRWSKAVFISPYNSQNYVASRMLGLQIQTVDSSQGSEYDYVIYTQTSDTAHACNVNRFNVAITRAKKGI
LCIMCDRSLFDVLKFFELKLSDLQANEGCGLFKDCSRGDDLLPPSHANTFMSLADNFKTDQDLAVQIGVNGPIKYEHVIS
FMGFRFDINIPNHHTLFCTRDFAMRNVRGWLGFDVEGAHVVGSNVGTNVPLQLGFSNGVDFVVRPEGCVVTESGDYIKPV
RARAPPGEQFAHLLPLLKRGQPWDVVRKRIVQMCSDYLANLSDILIFVLWAGGLELTTMRYFVKIGPSKSCDCGKVATCY
NSALHTYCCFKHALGCDYLYNPYCIDIQQWGYKGSLSLNHHEHCNVHRNEHVASGDAIMTRCLAIHDCFVKNVDWSITYP
FIGNEAVINKSGRIVQSHTMRSVLKLYNPKAIYDIGNPKGIRCAVTDAKWFCFDKNPTNSNVKTLEYDYITHGQFDGLCL
FWNCNVDMYPEFSVVCRFDTRCRSPLNLEGCNGGSLYVNNHAFHTPAFDKRAFAKLKPMPFFFYDDTECDKLQDSINYVP
LRASNCITKCNVGGAVCSKHCAMYHSYVNAYNTFTSAGFTIWVPTSFDTYNLWQTFSNNLQGLENIAFNVVKKGSFVGAE
GELPVAVVNDKVLVRDGTVDTLVFTNKTSLPTNVAFELYAKRKVGLTPPITILRNLGVVCTSKCVIWDYEAERPLTTFTK
DVCKYTDFEGDVCTLFDNSIVGSLERFSMTQNAVLMSLTAVKKLTGIKLTYGYLNGVPVNTHEDKPFTWYIYTRKNGKFE
DHPDGYFTQGRTTADFSPRSDMEKDFLSMDMGLFINKYGLEDYGFEHVVYGDVSKTTLGGLHLLISQVRLACMGVLKIDE
FVSSNDSTLKSCTVTYADNPSSKMVCTYMDLLLDDFVSILKSLDLSVVSKVHEVMVDCKMWRWMLWCKDHKLQTFYPQLQ
ASEWKCGYSMPSIYKIQRMCLEPCNLYNYGAGIKLPDGIMFNVVKYTQLCQYLNSTTMCVPHHMRVLHLGAGSDKGVAPG
TAVLRRWLPLDAIIVDNDSVDYVSDADYSVTGDCSTLYLSDKFDLVISDMYDGKIKSCDGENVSKEGFFPYINGVITEKL
ALGGTVAIKVTEFSWNKKLYELIQKFEYWTMFCTSVNTSSSEAFLIGVHYLGDFASGAVIDGNTMHANYIFWRNSTIMTM
SYNSVLDLSKFNCKHKATVVINLKDSSISDVVLGLLKNGKLLVRNNDAICGFSNHLVNVNK.

USA/IL/2014/20697-P8R1 Spike protein (SEQ ID NO: 18)
MKSLNYFWLFLPVLSTLSLPQDVTRCQSTINFRRFFSKFNVQAPAVVLLGGYLPSMNSSSWYCGTGLETASGVHGIFLSY
IDAGQGFEIGISQEPFDPSGYQLYLHKATNGNHNAIARLRICQFPDNKTLGPTVNDVTTGRNCLFNKAIPAYMQDGKNIV
VGITWDNDRVTVFADKIYHFYLKNDWSRVATRCYNKRSCAMQYVYTPTYYMLNVTSAGEDGIYYEPCTANCSGYAANVFA
TDSNGHIPEGFSFNNWFLLSNDSTLLHGKVVSNQPLLVNCLLAIPKIYGLGQFFSFNQTMDGVCNGAAAQRAPEALRFNI
NDTSVILAEGSIVLHTALGTNLSFVCSNSSDPHLATFAIPLGATQVPYYCFLKVDTYNSTVYKFLAVLPPTVREIVITKY
GDVYVNGFGYLHLGLLDAVTINFTGHGTDDDVSGFWTIASTNFVDALIEVQGTAIQRILYCDDPVSQLKCSQVAFDLDDG
FYPISSRNLLSHEQPISFVTLPSFNDHSFVNITVSASFGGHSGANLIASDTTINGFSSFCVDTRQFTISLFYNVTNSYGY
VSKSQDSNCPFTLQSVNDYLSFSKFCVSTSLLASACTIDLFGYPEFGSGVKFTSLYFQFTKGELITGTPKPLEGVTDVSS
MTLDVCTKYTIYGFKGEGIITLTNSSFLAGVYYTSDSGQLLAFKNVTSGAVYSVTPCSFSEQAAYVDDDIVGVISSLSSS
TFNSTRELPGFFYHSNDGSNCTEPVLVYSNIGVCKSGSIGYVPSQSGQVKIAPTVTGNISIPTNFSMSIRTEYLQLYNTP
VSVDCATYVCNGNSRCKQLLTQYTAACKTIESALQLSARLESVEVNSMLTISEEALQLATISSFNGDGYNFTNVLGVSVY
DPASGRVVQKRSFIEDLLFNKVVTNGLGTVDEDYKRCSNGRSVADLVCAQYYSGVMVLPGVVDAEKLHMYSASLIGGMVL
GGFTSAAALPFSYAVQARLNYLALQTDVLQRNQQLLAESFNSAIGNITPAFESVKEAISQTSKGLNTVAHALTKVQEVVN
SQGAALTQLTVQLQHNFQAISSSIDDIYSRLDILSADVQVDRLITGRLSALNAFVAQTLTKYTEVQASRKLAQQKVNECV
KSQSQRYGFCGGDGEHIFSLVQAAPQGLLFLHTVLVPSDFVDVIAIAGLCVNDEIALTLREPGLVLFTHELQNHTATEYF
VSSRRMFEPRKPTVSDFVQIESCVVTYVNLTRDQLPDVIPDYIDVNKTLDEILASLPNRTGPSLPLDVFNATYLNLTGEI
ADLEQRSESLRNTTEELQSLIYNINNTLVDLEWLNRVETYIKWPWWVWLIIFIVLIFVVSLLVFCCISTGCCGCCGCCCA
CFSGCCRGPRLQPYEVFEKVHVQ.

>USA/IL/2014/20697-P8R1 ORF3 protein (Truncated due to deletion/frameshift)(SEQ ID NO:19)
MFLGLFQYTIDTVVKDVSKSANLSLDAVQELELNVVPIRQASNVTGFLFTSVFIYFFALFKASSLRRNYIMLAARFAVIV

Fig. 22A2

LYCPLLYYCGAFLDATIICCTLIGRLCLVCFYSWRYKNALFIIFNTTTLSFLNGKAALTANPL.

>USA/IL/2014/20697-P8R1 Envelope protein (SEQ ID NO:20)
MLQLVNDNGLVVNVILWLFVLFFLLIISITFVQLVNLCFTCHRLCNSAVYTPIGRLYRVYKSYMQIDPLPSTVIDV.

>USA/IL/2014/20697-P8R1 Membrane protein (SEQ ID NO:21)
MSNGSIPVDEVIQHLRNWNFTWNIILTILLVVLQYGHYKYSAFLYGVKMAILWILWPLVLALSLFDAWASFQVNWVFFAF
SILMACITLMLWIMYFVNSIRLWRRTHSWWSFNPETDALLTTSVMGRQVCIPVLGAPTGVTLTLLSGTLLVEGYKVATGV
QVSQLPNFVTVAKATTTIVYGRVGRSVNASSGTGWAFYVRSKHGDYSAVSNPSSVLTDSEKVLHLV.

>USA/IL/2014/20697-P8R1 Nucleocapsid protein (SEQ ID NO:22)
MASVSFQDRGRKRVPLSLYAPLRVTNHKPLSKVLANNAVPTNKGNKDQQIGYWTEQIRWRMRRGERIEQPSNWHFYYLGT
GPHADLRYRTRTEGVFWVAKEGAKTEPTNLGVRKASEKPIIPNFSQQLPSVVEIVEPNTPPTSRANSRSRSRGNGNNRSR
SPSNNRGNNQSRGNSQNRGNNQGRGASQNRGGNNNNNNKSRNQSKNRNQSNDRGGVTSRDDLVAAVKDALKSLGIGENPD
KLKQQQKPKQERSDSSGKNTPKKNKSRATSKERDLKDIPEWRRIPKGENSVAACFGPRGGFKNFGDAEFVEKGVDASGYA
QIASLAPNVAALLFGGNVAVRELADSYEITYNYKMTVPKSDPNVELLVSQVDAFKTGNAKPQRKKEKKNKRETTQQLNEE
AIYDDVGVPSDVTHANLEWDTAVDGGDTAVEIINEIFDTGN.

Fig. 22A3

Fig. 22B1 USA/IL/2014/20697-P18R1 clone G8b ORF1a/1b polyprotein (SEQ ID NO:23)

MASNHVTLAFANDAEISAFGFCTASEAVSYYSEAAASGFMQCRFVSFDLADTVEGLLPEDYVMVVVGTTKLSAYVDTFGS
RPKNICGWLLFSNCNYFLEELELTFGRRGGNIVPVDQYMCGADGKPVLQESEWEYTDFFADSEDGQLNIAGITYVKAWIV
ERSDVSYASQNLTSIKSITYCSTYEHTFPDGTAMKVARTPKIKKTVVLSEPLATIYREIGSPFVDNGSDARSIIKRPVFL
HAFVKCKCGSYHWTVGDWTSYVSTCCGFKCKPVLVASCSATPGSVVVTRAGAGTGVKYYNNMFLRHVADIDGLAFWRILK
VQSKDDLACSGKFLEHHEEGFTDPCYFLNDSSIATKLKFDILSGKFSDEVKQAIFAGHVVVGSALVDIVDDALGQPWFIR
KLGDLASAAWEQLKAVVRGLNLLSDEVVLFGKRLSCATLSIVNGVFEFIAEVPEKLAAAVTVFVNFLNELFESACDCLKV
GGKTFNKVGSYVLFDNALVKLVKAKVRGPRQAGVCEVRYTSLVIGSTTKVVSKRVENANVNLVVVDEDATLNTTGRTVVV
DGLAFFESDGFYRHLADADVVIEHPVYKSACELKPVFECDPIPDFPMPVAASVAELCVQTDLLLKNYNTPYKTYSCVVRG
DKCCITCTLHFTAPSYMEAAANFVDLCTKNIGTAGFHEFYITAHEQQDLQGFVTTCCTMSGFECFMPIIPQCPAVLEEID
GGSIWRSFITGLNTMWDFCKHLKVSFGLDGIVVTVARKFKRLGALLAEMYNTYLSTVVENLVLAGVSFKYYATSVPKIVL
GCCFHSVKSVLASAFQIPVQAGVEKFKVFLNCVHPVVPRVIETSFVELEETTFKPPALNGSIAIVDGFAFYYDGTLYYPT
DGNSVVPICFKKKGGGDVKFSDEVSVKTIDPVYKVSLEFEFESETIMAVLNKAVGNCIKVTGGWDDVVEYINVAIEVLKD
HIDVPKYYIYDEEGGTDPNLPVMVSQWPLNDDTISQDLLDVEVVTDAPVDFEGDEVDSSDPDKVADVANSEPEDDGLNVA
PETNVESEVEEVAATLSFIKDTPSTVTKDPFAFDFASYGGLKVLRQSHNNCWVTSTLVQLQLLGIVDDPAMELFSAGRVG
PMVRKCYESQKAILGSLGDVSACLESLTKDLHTLKITCSVVCGCGTGERIYDGCAFRMTPTLEPFPYGACAQCAQVLMHT
FKSIVGTGIFCRDTTALSLDSLVVKPLCAAAFIGKDSGHYVTNFYDAAMAIDGYGRHQIKYDTLNTICVKDVNWTAPFVP
DVEPVLEPVVKPFYSYKNVDFYQGDFSDLVKLPCDFVVNAANENLSHGGGIAKAIDVYTRGMLQKCSNDYIKAHGPIKVG
RGVMLEALGLKVFNVVGPRKGKHAPELLVKAYKSVFANSGVALTPLISVGIFSVPLEESLSAFLACVGDRHCKCFCYSDK
EREAIINYMDGLVDAIFKDALVDTTPVQEDVQQVSQKPVLPNFEPFRIEGAHAFYECNPEGLMSLGADKLVLFTNSNLDF
CSVGKCLNNVTGGALLEAINVFKKSNKTVPAGNCVTFECADMISITMVVLPSDGDANYDKNYARAVVKVSKLKGKLLLAV
GDAMLYSKLSHLSVLGFVSTPDDVERFYANKSVVIKVTEDTRSVKTVKVESTVTYGQQIGPCLVNDTVVTDNKPVVADVV
AKVVPSANWDSHYGFDKAGEFHMLDHTGFAFPSEVVNGRRVLKTTDNNCWVNVTCLQLQFARFRFKSAGLQAMWESYCTG
DVAMFVHWLYWLTGVDKGQPSDSENALNMLSKYIVPAGSVTIERVTHDGCCCSKRVVTAPVVNASVLKLGVEDGLCPHGL
NYIDKVVVVKGTTIVVNVGKPVVAPSHLFLKGVSYTTFLDNGNGVAGHYTVFDHDTGMVHDGDVFVPGDLNVSPVTNVVV
SEQTAVVIKDPVKKVELDATKLLDTMNYASERFFSFGDFMSRNLITVFLYILSILGLCFRAFRKRDVKVLAGVPQRTGII
LRKSVRYNAKALGVFFKLKLYWFKVLGKFSLGIYALYALLFMTIRFTPIGGPVCDDVVAGYANSSFDKNEYCNSVICKVC
LYGYQELSDFSHTQVVWQHLRDPLIGNVMPFFYLAFLAIFGGVYVKAITLYFIFQYLNILGVFLGLQQSIWFLQLVPFDV
FGDEIVVFFIVTRVLMFLKHVFLGCDKASCVACSKSARLKRVPVQTIFQGTSKSFYVHANGGSKFCKKHNFFCLNCDSYG
PGCTFINDVIATEVGNVVKLNVQPTGPATILIDKVEFSNGFYYLYSGDTFWKYNFDITDNKYTCKESLKNCSIITDFIVF
NNNGSNVNQVKNACVYFSQMLCKPVKLVDSALLASLSVDFGASLHSAFVSVLSNSFGKDLSSCNDMQDCKSTLGFDDVPL
DTFNAAVAEAHRYDVLLTDMSFNNFTTSYAKPEEKLPVHDIATCMRVGAKIVNHNVLVKDSIPVVWLVRDFIALSEETRK
YIIRTTKVKGITFMLTFNDCRMHTTIPTVCIANKKGAGLPSFSKVKKFFWFLCLFIVAVFFALSFFDFSTQVSSDSDYDF
KYIESGQLKTFDNPLSCVHNVFSNFDQWHDAKFGFTPVNNPSCPIVVGVSDEARTVPGIPAGVYLAGKTLVFAINTIFGT
SGLCFDASGVADKGACIFNSACTTLSGLGGTAVYCYKNGLVEGAKLYSELAPHSYYKMVDGNTVSLPEIISRGFGIRTIR
TKAMTYCRVGQCVQSAEGVCFGADRFFVYNAESGSDFVCGTGLFTLLMNVISVFSKTVPVTVLSGQILFNCIIAFAAVAV
CFLFTKFKRMFGDMSVGVFTVGACTLLNNVSYIVTQNTLGMLGYATLYFLCTKGVRYMWIWHLGFLISYILIAPWWVLMV
YAFSAIFEFMPNLFKLKVSTQLFEGDKFVGSFENAAAGTFVLDMHAYERLANSISTEKLRQYASTYNKYKYYSGSASEAD
YRLACFAHLAKAMMDYASNHNDTLYTPPTVSYNSTLQAGLRKMAQPSGVVEKCIVRVCYGNMALNGLWLGDTVICPRHVI
ASSTTSTIDYDYALSVLRLHNFSISSGNVFLGVVGVTMRGALLQIKVNQNNVHTPKYTYRTVRPGESFNILACYDGSAAG
VYGVNMRSNYTIRGSFINGACGSPGYNINNGTVEFCYLHQLELGSGCHVGSDLDGVMYGGYEDQPTLQVEGASSLFTENV
LAFLYAALINGSTWWLSSSRIAVDRFNEWAVHNGMTTVVNTDCFSILAAKTGVDVQRLLASIQSLHKNFGGKQILGYTSL
TDEFTTGEVIRQMYGVNLQSGYVSRACRNVLLVGSFLTFFWSELVSYTKFFWVNPGYVTPMFACLSLLSSLLMFTLKHKT
LFFQVFLIPALIVTSCINLAFDVEVYNYLAEHFDYHVSLMGFNAQGLVNIFVCFVVTILHGTYTWRFFNTPVSSVTYVVA
LLTAAYNYFYASDILSCAMTLFASVTGNWFVGAVCYKAAVYMALRFPTFVAIFGDIKSVMFCYLVLGYFTCCFYGILYWF
NRFFKVSVGVYDYTVSAAEFKYMVANGLRAPTGTLDSLLLSAKLIGIGGERNIKISSVQSKLTDIKCSNVVLLGCLSSMN
VSANSTEWAYCVDLHNKINLCNDPEKAQEMLLALLAFFLSKNSAFGLDDLLESYFNDNSMLQSVASTYVGLPSYVIYENA
RQQYEDAVNNGSPPQLVKQLRHAMNVAKSEFDREASTQRKLDRMAEQAAAQMYKEARAVNRKSKVVSAMHSLLFGMLRRL
DMSSVDTILNLAKDGVVPLSVIPAVSATKLNIVTSDIDSYNRIQREGCVHYAGTIWNIIDIKDNDGKVVHVKEVTAQNAE
SLSWPLVLGCERIVKLQNNEIIPGKLKQRSIKAEGDGIVGEGKALYNNEGGRTFMYAFISDKPDLRVVKWEFDGGCNTIE
LEPPRKFLVDSPNGAQIKYLYFVRNLNTLRRGAVLGYIGATVRLQAGKQTEQAINSSLLTLCAFAVDPAKTYIDAVKSGH
KPVGNCVKMLANGSGNGQAVTNGVEASTNQDSYGGASVCLYCRAHVEHPSMDGFCRLKGKYVQVPLGTVDPIRFVLENDV
CKVCGCWLANGCTCDRSIMQSTDMAYLNRVRGSSAARLEPCNGTDTQHVYRAFDIYNKDVACLGKFLKVNCVRLKNLDKH
DAFYVVKRCTKSAMEHEQSIYSRLEKCGAVAEHDFFTWKDGRAIYGNVCRKDLTEYTMMDLCYALRNFDENNCDVLKSIL
IKVGACEESYFNNKVWFDPVENEDIHRVYALLGTIVSRAMLKCVKFCDAMVEQGIVGVVTLDNQDLNGDFYDFGDFTCSI

KGMGIPICTSYYSYMMPVMGMTNCLASECFVKSDIFGEDFKSYDLLEYDFTEHKTALFNKYFKYWGLQYHPNCVDCSDEQ
CIVHCANFNTLFSTTIPITAFGPLCRKCWIDGVPLVTTAGYHFKQLGIVWNNDLNLHSSRLSINELLQFCSDPALLIASS
PALVDQRTVCFSVAALGTGMTNQTVKPGHFNKEFYDFLLEQGFFSEGSELTLKHFFFAQKGDAAVKDFDYYRYNRPTVLD
ICQARVVYQIVQRYFDIYEGGCITAKEVVVTNLNKSAGYPLNKFGKAGLYYESLSYEEQDELYAYTKRNILPTMTQLNLK
YAISGKERARTVGGVSLLSTMTTRQYHQKHLKSIVNTRGASVVIGTTKFYGGWDNMLKNLIDGVENPCLMGWDYPKCDRA
LPNMIRMISAMILGSKHTTCCSSTDRFFRLCNELAQVLTEVVYSNGGFYLKPGGTTSGDATTAYANSVFNIFQAVSANVN
KLLSVDSNVCHNLEVKQLQRKLYECCYRSTTVDDQFVVEYYGYLRKHFSMMILSDDGVVCYNNDYASLGYVADLNAFKAV
LYYQNNVFMSASKCWIEPDINKGPHEFCSQHTMQIVDKDGTYYLPYPDPSRILSAGVFVDDVVKTDAVVLLERYVSLAID
AYPLSKHENPEYKKVFYVLLDWVKHLYKTLNAGVLESFSVTLLEDSTAKFWDESFYANMYEKSAVLQSAGLCVVCGSQTV
LRCGDCLRRPMLCTKCAYDHVIGTTHKFILAITPYVCCASDCGVNDVTKLYLGGLSYWCHDHKPRLAFPLCSAGNVFGLY
KNSATGSPDVEDFNRIATSDWTDVSDYRLANDVKDSLRLFAAETIKAKEESVKSSYACATLHEVVGPKELLLKWEVGRPK
PPLNRNSVFTCYHITKNTKFQIGEFVFEKAEYDNDAVTYKTTATTKLVPGMVFVLTSHNVQPLRAPTIANQERYSTIHKL
HPAFNIPEAYSSLVPYYQLIGKQKITTIQGPPGSGKSHCVIGLGLYYPGARIVFTACSHAAVDSLCVKASTAYSNDKCSR
IIPQRARVECYDGFKSNNTSAQYLFSTVNALPECNADIVVVDEVSMCTNYDLSVINQRISYRHVVYVGDPQQLPAPRVMI
SRGTLEPKDYNVVTQRMCALKPDVFLHKCYRCPAEIVRTVSEMVYENQFIPVHPDSKQCFKIFCKGNVQVDNGSSINRRQ
LDVVRMFLAKNPRWSKAVFISPYNSQNYVASRMLGLQIQTVDSSQGSEYDYVIYTQTSDTAHACNVNRFNVAITRAKKGI
LCIMCDRSLFDVLKFFELKLSDLQANEGCGLFKDCSRGDDLLPPSHANTFMSLADNFKTDQDLAVQIGVNGPIKYEHVIS
FMGFRFDINIPNHHTLFCTRDFAMRNVRGWLGFDVEGAHVVGSNVGTNVPLQLGFSNGVDFVVRPEGCVVTESGDYIKPV
RARAPPGEQFAHLLPLLKRGQPWDVVRKRIVQMCSDYLANLSDILIFVLWAGGLELTTMRYFVKIGPSKSCDCGKVATCY
NSALHTYCCFKHALGCDYLYNPYCIDIQQWGYKGSLSLNHHEHCNVHRNEHVASGDAIMTRCLAIHDCFVKNVDWSITYP
FIGNEAVINKSGRIVQSHTMRSVLKLYNPKAIYDIGNPKGIRCAVTDAKWFCFDKNPTNSNVKTLEYDYITHGQFDGLCL
FWNCNVDMYPEFSVVCRFDTRCRSPLNLEGCNGGSLYVNNHAFHTPAFDKRAFAKLKPMPFFFYDDTECDKLQDSINYVP
LRASNCITKCNVGGAVCSKHCAMYHSYVNAYNTFTSAGFTIWVPTSFDTYNLWQTFSNNLQGLENIAFNVVKKGSFVGAE
GELPVAVVNDKVLVRDGTVDTLVFTNKTSLPTNVAFELYAKRKVGLTPPITILRNLGVVCTSKCVIWDYEAERPLTTFTK
DVCKYTDFEGDVCTLFDNSIVGSLERFSMTQNAVLMSLTAVKKLTGIKLTYGYLNGVPVNTHEDKPFTWYIYTRKNGKFE
DHPDGYFTQGRTTADFSPRSDMEKDFLSMDMGLFINKYGLEDYGFEHVVYGDVSKTTLGGLHLLISQVRLACMGVLKIDE
FVSSNDSTLKSCTVTYADNPSSKMVCTYMDLLLDDFVSILKSLDLSVVSKVHEVMVDCKMWRWMLWCKDHKLQTFYPQLQ
ASEWKCGYSMPSIYKIQRMCLEPCNLYNYGAGIKLPDGIMFNVVKYTQLCQYLNSTTMCVPHHMRVLHLGAGSDKGVAPG
TAVLRRWLPLDAIIVDNDSVDYVSDADYSVTGDCSTLYLSDKFDLVISDMYDGKIKSCDGENVSKEGFFPYINGVITEKL
ALGGTVAIKVTEFSWNKKLYELIQKFEYWTMFCTSVNTSSSEAFLIGVHYLGDFASGAVIDGNTMHANYIFWRNSTIMTM
SYNSVLDLSKFNCKHKATVVINLKDSSISDVVLGLLKNGKLLVRNNDAICGFSNHLVNVNK.

>USA/IL/2014/20697-P18R1 clone G8b Spike protein (SEQ ID NO:24)
MKSLNYFWLFLPVLSTLSLPQDVTRCQSTINFRRFFSKFNVQAPAVVLLGGYLPSMNSSSWYCGTGLETASGVHGIFLSY
IDAGQGFEIGISQEPFDPSGYQLYLHKATNGNHNAIARLRICQFPDNKTLGPTVNDVTTGRNCLFNKAIPAYMQDGKNIV
VGITWDNDRVTVFADKIYHFYLKNDWSRVATRCYNKRSCAMQYVYTPTYYMLNVTSAGEDGIYYEPCTANCSGYAANVFA
TDSNGHIPEGFSFNNWFLLSNDSTLLHGKVVSNQPLLVNCLLAIPKIYGLGQFFSFNQTMDGVCNGAAAQRAPEALRFNI
NDTSVILAEGSIVLHTALGTNLSFVCSNSSDPHLATFAIPLGATQVPYYCFLKVDTYNSTVYKFLAVLPPTVREIVITKY
GDVYVNGFGYLHLGLLDAVTINFTGHGTDDDVSGFWTIASTNFVDALIEVQGTAIQRILYCDDPVSQLKCSQVAFDLDDG
FYPISSRNLLSHEQPISFVTLPSFNDHSFVNITVSASFGGHSGANLIASDTTINGFSSFCVDTRQFTISLFYNVTNSYGY
VSKSQDSNCPFTLQSVNDYLSFSKFCVSTSLLASACTIDLFGYPEFGSGVKFTSLYFQFTKGELITGTPKPLEGVTDVSS
MTLDVCTKYTIYGFKGEGIITLTNSSFLAGVYYTSDSGQLLAFKNVTSGAVYSVTPCSFSEQAAYVDDDIVGVISSLSSS
TFNSTRELPGFFYHSNDGSNCTEPVLVYSNIGVCKSGSIGYVPSQSGQVKIAPTVTGNISIPTNFSMSIRTEYLQLYNTP
VSVDCATYVCNGNSRCKQLLTQYTAACKTIESALQLSARLESVEVNSMLTISEEALQLATISSFNGDGYNFTNVLGVSVY
DPASGRVVQKRSFIEDLLFNKVVTNGLGTVDEDYKRCSNGRSVADLVCAQYYSGVMVLPGVVDAEKLHMYSASLIGGMVL
GGFTSAAALPFSHAVQARLNYLALQTDVLQRNQQLLAESFNSAIGNITPAFESVKEAISQTSKGLNTVAHALTKVQEVVN
SQGAALTQLTVQLQHNFQAISSSIDDIYSRLDILSADVQVDRLITGRLSALNAFVAQTLTKYTEVQASRKLAQQKVNECV
KSQSQRYGFCGGDGEHIFSLVQAAPQGLLFLHTVLVPSDFVDVIAIAGLCVNDEIALTLREPGLVLFTHELQNHTATEYF
VSSRRMFEPRKPTVSDFVQIESCVVTYVNLTRDQLPDVIPDYIDVNKTLDEILASLPNRTGPSLPLDVFNATYLNLTGEI
ADLEQRSESLRNTTEELQSLIYNINNTLVDLEWLNRVETYIKWPWWVWLIIFIVLIFVVSLLVFCCISTGCCGCCGCCCA
CFSGCCRGPRLQPYEVFEKVHVQ.

>USA/IL/2014/20697-P18R1 clone G8b ORF3 protein (Truncated due to deletion/frameshift)(SEQ ID NO:25)
MFLGLFQYTIDTVVKDVSKSANLSLDAVQELELNVVPIRQASNVTGFLFTSVFIYFFALFKASSLRRNYIMLAARFAVIV

Fig. 22B2

LYCPLLYYCGAFLDATIICCTLIGRLCLVCFYSWRYKNALFIIFNTTTLSFLNGKAALTANPL.

>USA/IL/2014/20697-P18R1 clone G8b Envelope protein (SEQ ID NO:26)
MLQLVNDNGLVVNVILWLFVLFFLLIISITFVQLVNLCFTCHRLCNSAVYTPIGRLYRVYKSYMQIDPLPSTVIDV.

>USA/IL/2014/20697-P18R1 clone G8b Membrane protein (SEQ ID NO:27)
MSNGSIPVDEVIQHLRNWNFTWNIILTILLVVLQYGHYKYSAFLYGVKMAILWILWPLVLALSLFDAWASFQVNWVFFAF
SILMACITLMLWIMYFVNSIRLWRRTHSWWSFNPETDALLTTSVMGRQVCIPVLGAPTGVTLTLLSGTLLVEGYKVATGV
QVSQLPNFVTVAKATTTIVYGRVGRSVNASSGTGWAFYVRSKHGDYSAVSNPSSVLTDSEKVLHLV.

>USA/IL/2014/20697-P18R1 clone G8b Nucleocapsid protein (SEQ ID NO:28)
MASVSFQDRGRKRVPLSLYAPLRVTNHKPLSKVLANNAVPTNKGNKDQQIGYWTEQIRWRMRRGERIEQPSNWHFYYLGT
GPHADLRYRTRTEGVFWVAKEGAKTEPTNLGVRKASEKPIIPNFSQQLPSVVEIVEPNTPPTSRANSRSRSRGNGNNRSR
SPSNNRGNNQSRGNSQNRGNNQGRGASQNRGGNNNNNNKSRNQSKNRNQSNDRGGVTSRDDLVAAVKDALKSLGIGENPD
KLKQQQKPKQERSDSSGKNTPKKNKSRATSKERDLKDIPEWRRIPKGENSVAACFGPRGGFKNFGDAEFVEKGVDASGYA
QIASLAPNVAALLFGGNVAVRELADSYEITYNYKMTVPKSDPNVELLVSQVDAFKTGNAKPQRKKEKKNKRETTQQLNEE
AIYDDVGVPSDVTHANLEWDTAVDGGDTAVEIINEIFDTGN.

Fig. 22B3

Fig. 22C1 USA/IL/2014/20697-P18R1 F6a ORF1a/1b polyprotein (SEQ ID NO:29)

MASNHVTLAFANDAEISAFGFCTASEAVSYYSEAAASGFMQCRFVSFDLADTVEGLLPEDYVMVVVGTTKLSAYVDTFGS
RPKNICGWLLFSNCNYFLEELELTFGRRGGNIVPVDQYMCGADGKPVLQESEWEYTDFFADSEDGQLNIAGITYVKAWIV
ERSDVSYASQNLTSIKSITYCSTYEHTFPDGTAMKVARTPKIKKTVVLSEPLATIYREIGSPFVDNGSDARSIIKRPVFL
HAFVKCKCGSYHWTVGDWTSYVSTCCGFKCKPVLVASCSATPGSVVVTRAGAGTGVKYYNNMFLRHVADIDGLAFWRILK
VQSKDDLACSGKFLEHHEEGFTDPCYFLNDSSIATKLKFDILSGKFSDEVKQAIFAGHVVVGSALVDIVDDALGQPWFIR
KLGDLASAAWEQLKAVVRGLNLLSDEVVLFGKRLSCATLSIVNGVFEFIAEVPEKLAAAVTVFVNFLNELFESACDCLKV
GGKTFNKVGSYVLFDNALVKLVKAKVRGPRQAGVCEVRYTSLVIGSTTKVVSKRVENANVNLVVVDEDATPNTTGRTVVV
DGLAFFESDGFYRHLADADVVIEHPVYKSACELKPVFECDPIPDFPMPVAASVAELCVQTDLLLKNYNTPYKTYSCVVRG
DKCCITCTLHFTAPSYMEAAANFVDLCTKNIGTAGFHEFYITAHEQQDLQGFVTTCCTMSGFECFMPIIPQCPAVLEEID
GGSIWRSFITGLNTMWDFCKHLKVSFGLDGIVVTVARKFKRLGALLAEMYNTYLSTVVENLVLAGVSFKYYATSVPKIVL
GCCFHSVKSVLASAFQIPVQAGVEKFKVFLNCVHPVVPRVIETSFVELEETTFKPPALNGSIAIVDGFAFYYDGTLYYPT
DGNSVVPICFKKKGGGDVKFSDEVSVKTIDPVYKVSLEFEFESETIMAVLNKAVGNCIKVTGGWDDVVEYINVAIEVLKD
HIDVPKYYIYDEEGGTDPNLPVMVSQWPLNDDTISQDLLDVEVVTDAPVDFEGDEVDSSDPDKVADVANSEPEDDGLNVA
PETNVESEVEEVAATLSFIKDTPSTVTKDPFAFDFASYGGLKVLRQSHNNCWVTSTLVQLQLLGIVDDPAMELFSAGRVG
PMVRKCYESQKAILGSLGDVSACLESLTKDLHTLKITCSVVCGCGTGERIYDGCAFRMTPTLEPFPYGACAQCAQVLMHT
FKSIVGTGIFCRDTTALSLDSLVVKPLCAAAFIGKDSGHYVTNFYDAAMAIDGYGRHQIKYDTLNTICVKDVNWTAPFVP
DVEPVLEPVVKPFYSYKNVDFYQGDFSDLVKLPCDFVVNAANENLSHGGGIAKAIDVYTRGMLQKCSNDYIKAHGPIKVG
RGVMLEALGLKVFNVVGPRKGKHAPELLVKAYKSVFANSGVALTPLISVGIFSVPLEESLSAFLACVGDRHCKCFCYSDK
EREAIINYMDGLVDAIFKDALVDTTPVQEDVQQVSQKPVLPNFEPFRIEGAHAFYECNPEGLMSLGADKLVLFTNSNLDF
CSVGKCLNNVTGGALLEAINVFKKSNKTVPAGNCVTFECADMISITMVVLPSDGDANYDKNYARAVVKVSKLKGKLLLAV
GDAMLYSKLSHLSVLGFVSTPDDVERFYANKSVVIKVTEDTRSVKTVKVESTVTYGQQIGPCLVNDTVVTDNKPVVADVV
AKVVPSANWDSHYGFDKAGEFHMLDHTGFAFPSEVVNGRRVLKTTDNNCWVNVTCLQLQFARFRFKSAGLQAMWESYCTG
DVAMFVHWLYWLTGVDKGQPSDSENALNMLSKYIVPAGSVTIERVTHDGCCCSKRVVTAPVVNASVLKLGVEDGLCPHGL
NYIDKVVVVKGTTIVVNVGKPVVAPSHLFLKGVSYTTFLDNGNGVAGHYTVFDHDTGMVHDGDVFVPGDLNVSPVTNVVV
SEQTAVVIKDPVKKVELDATKLLDTMNYASERFFSFGDFMSRNLITVFLYILSILGLCFRAFRKRDVKVLAGVPQRTGII
LRKSVRYNAKALGVFFKLKLYWFKVLGKFSLGIYALYALLFMTIRFTPIGGPVCDDVVAGYANSSFDKNEYCNSVICKVC
LYGYQELSDFSHTQVVWQHLRDPLIGNVMPFFYLAFLAIFGGVYVKAITLYFIFQYLNILGVFLGLQQSIWFLQLVPFDV
FGDEIVVFFIVTRVLMFLKHVFLGCDKASCVACSKSARLKRVPVQTIFQGTSKSFYVHANGGSKFCKKHNFFCLNCDSYG
PGCTFINDVIATEVGNVVKLNVQPTGPATILIDKVEFSNGFYYLYSGDTFWKYNFDITDNKYTCKESLKNCSIITDFIVF
NNNGSNVNQVKNACVYFSQMLCKPVKLVDSALLASLSVDFGASLHSAFVSVLSNSFGKDLSSCNDMQDCKSTLGFDDVPL
DTFNAAVAEAHRYDVLLTDMSFNNFTTSYAKPEEKLPVHDIATCMRVGAKIVNHNVLVKDSIPVVWLVRDFIALSEETRK
YIIRTTKVKGITFMLTFNDCRMHTTIPTVCIANKKGAGLPSFSKVKKFFWFLCLFIVAVFFALSFFDFSTQVSSDSDYDF
KYIESGQLKTFDNPLSCVHNVFSNFDQWHDAKFGFTPVNNPSCPIVVGVSDEARTVPGIPAGVYLAGKTLVFAINTIFGT
SGLCFDASGVADKGACIFNSACTTLSGLGGTAVYCYKNGLVEGAKLYSELAPHSYYKMVDGNTVSLPEIISRGFGIRTIR
TKAMTYCRVGQCVQSAEGVCFGADRFFVYNAESGSDFVCGTGLFTLLMNVISVFSKTVPVTVLSGQILFNCIIAFAAVAV
CFLFTKFKRMFGDMSVGVFTVGACTLLNNVSYIVTQNTLGMLGYATLYFLCTKGVRYMWIWHLGFLISYILIAPWWVLMV
YAFSAIFEFMPNLFKLKVSTQLFEGDKFVGSFENAAAGTFVLDMHAYERLANSISTEKLRQYASTYNKYKYYSGSASEAD
YRLACFAHLAKAMMDYASNHNDTLYTPPTVSYNSTLQAGLRKMAQPSGVVEKCIVRVCYGNMALNGLWLGDTVICPRHVI
ASSTTSTIDYDYALSVLRLHNFSISSGNVFLGVVGVTMRGALLQIKVNQNNVHTPKYTYRTVRPGESFNILACYDGSAAG
VYGVNMRSNYTIRGSFINGACGSPGYNINNGTVEFCYLHQLELGSGCHVGSDLDGVMYGGYEDQPTLQVEGASSLFTENV
LAFLYAALINGSTWWLSSSRIAVDRFNEWAVHNGMTTVVNTDCFSILAAKTGVDVQRLLASIQSLHKNFGGKQILGYTSL
TDEFTTGEVIRQMYGVNLQSGYVSRACRNVLLVGSFLTFFWSELVSYTKFFWVNPGYVTPMFACLSLLSSLLMFTLKHKT
LFFQVFLIPALIVTSCINLAFDVEVYNYLAEHFDYHVSLMGFNAQGLVNIFVCFVVTILHGTYTWRFFNTPVSSVTYVVA
LLTAAYNYFYASDILSCAMTLFASVTGNWFVGAVCYKAAVYMALRFPTFVAIFGDIKSVMFCYLVLGYFTCCFYGILYWF
NRFFKVSVGVYDYTVSAAEFKYMVANGLRAPTGTLDSLLLSAKLIGIGGERNIKISSVQSKLTDIKCSNVVLLGCLSSMN
VSANSTEWAYCVDLHNKINLCNDPEKAQEMLLALLAFFLSKNSAFGLDDLLESYFNDNSMLQSVASTYVGLPSYVIYENA
RQQYEDAVNNGSPPQLVKQLRHAMNVAKSEFDREASTQRKLDRMAEQAAAQMYKEARAVNRKSKVVSAMHSLLFGMLRRL
DMSSVDTILNLAKDGVVPLSVIPAVSATKLNIVTSDIDSYNRIQREGCVHYAGTIWNIIDIKDNDGKVVHVKEVTAQNAE
SLSWPLVLGCERIVKLQNNEIIPGKLKQRSIKAEGDGIVGEGKALYNNEGGRTFMYAFISDKPDLRVVKWEFDGGCNTIE
LEPPRKFLVDSPNGAQIKYLYFVRNLNTLRRGAVLGYIGATVRLQAGKQTEQAINSSLLTLCAFAVDPAKTYIDAVKSGH
KPVGNCVKMLANGSGNGQAVTNGVEASTNQDSYGGASVCLYCRAHVEHPSMDGFCRLKGKYVQVPLGTVDPIRFVLENDV
CKVCGCWLANGCTCDRSIMQSTDMAYLNRVRGSSAARLEPCNGTDTQHVYRAFDIYNKDVACLGKFLKVNCVRLKNLDKH
DAFYVVKRCTKSAMEHEQSIYSRLEKCGAVAEHDFFTWKDGRAIYGNVCRKDLTEYTMMDLCYALRNFDENNCDVLKSIL
IKVGACEESYFNNKVWFDPVENEDIHRVYALLGTIVSRAMLKCVKFCDAMVEQGIVGVVTLDNQDLNGDFYDFGDFTCSI

KGMGIPICTSYYSYMMPVMGMTNCLASECFVKSDIFGEDFKSYDLLEYDFTEHKTALFNKYFKYWGLQYHPNCVDCSDEQ
CIVHCANFNTLFSTTIPITAFGPLCRKCWIDGVPLVTTAGYHFKQLGIVWNNDLNLHSSRLSINELLQFCSDPALLIASS
PALVDQRTVCFSVAALGTGMTNQTVKPGHFNKEFYDFLLEQGFFSEGSELTLKHFFFAQKGDAAVKDFDYYRYNRPTVLD
ICQARVVYQIVQRYFDIYEGGCITAKEVVVTNLNKSAGYPLNKFGKAGLYYESLSYEEQDELYAYTKRNILPTMTQLNLK
YAISGKERARTVGGVSLLSTMTTRQYHQKHLKSIVNTRGASVVIGTTKFYGGWDNMLKNLIDGVENPCLMGWDYPKCDRA
LPNMIRMISAMILGSKHTTCCSSTDRFFRLCNELAQVLTEVVYSNGGFYLKPGGTTSGDATTAYANSVFNIFQAVSANVN
KLLSVDSNVCHNLEVKQLQRKLYECCYRSTTVDDQFVVEYYGYLRKHFSMMILSDDGVVCYNNDYASLGYVADLNAFKAV
LYYQNNVFMSASKCWIEPDINKGPHEFCSQHTMQIVDKDGTYYLPYPDPSRILSAGVFVDDVVKTDAVVLLERYVSLAID
AYPLSKHENPEYKKVFYVLLDWVKHLYKTLNAGVLESFSVTLLEDSTAKFWDESFYANMYEKSAVLQSAGLCVVCGSQTV
LRCGDCLRRPMLCTKCAYDHVIGTTHKFILAITPYVCCASDCGVNDVTKLYLGGLSYWCHDHKPRLAFPLCSAGNVFGLY
KNSATGSPDVEDFNRIATSDWTDVSDYRLANDVKDSLRLFAAETIKAKEESVKSSYACATLHEVVGPKELLLKWEVGRPK
PPLNRNSVFTCYHITKNTKFQIGEFVFEKAEYDNDAVTYKTTATTKLVPGMVFVLTSHNVQPLRAPTIANQERYSTIHKL
HPAFNIPEAYSSLVPYYQLIGKQKITTIQGPPGSGKSHCVIGLGLYYPGARIVFTACSHAAVDSLCVKASTAYSNDKCSR
IIPQRARVECYDGFKSNNTSAQYLFSTVNALPECNADIVVVDEVSMCTNYDLSVINQRISYRHVVYVGDPQQLPAPRVMI
SRGTLEPKDYNVVTQRMCALKPDVFLHKCYRCPAEIVRTVSEMVYENQFIPVHPDSKQCFKIFCKGNVQVDNGSSINRRQ
LDVVRMFLAKNPRWSKAVFISPYNSQNYVASRMLGLQIQTVDSSQGSEYDYVIYTQTSDTAHACNVNRFNVAITRAKKGI
LCIMCDRSLFDVLKFFELKLSDLQANEGCGLFKDCSRGDDLLPPSHANTFMSLADNFKTDQDLAVQIGVNGPIKYEHVIS
FMGFRFDINIPNHHTLFCTRDFAMRNVRGWLGFDVEGAHVVGSNVGTNVPLQLGFSNGVDFVVRPEGCVVTESGDYIKPV
RARAPPGEQFAHLLPLLKRGQPWDVVRKRIVQMCSDYLANLSDILIFVLWAGGLELTTMRYFVKIGPSKSCDCGKVATCY
NSALHTYCCFKHALGCDYLYNPYCIDIQQWGYKGSLSLNHHEHCNVHRNEHVASGDAIMTRCLAIHDCFVKNVDWSITYP
FIGNEAVINKSGRIVQSHTMRSVLKLYNPKAIYDIGNPKGIRCAVTDAKWFCFDKNPTNSNVKTLEYDYITHGQFDGLCL
FWNCNVDMYPEFSVVCRFDTRCRSPLNLEGCNGGSLYVNNHAFHTPAFDKRAFAKLKPMPFFFYDDTECDKLQDSINYVP
LRASNCITKCNVGGAVCSKHCAMYHSYVNAYNTFTSAGFTIWVPTSFDTYNLWQTFSNNLQGLENIAFNVVKKGSFVGAE
GELPVAVVNDKVLVRDGTVDTLVFTNKTSLPTNVAFELYAKRKVGLTPPITILRNLGVVCTSKCVIWDYEAERPLTTFTK
DVCKYTDFEGDVCTLFDNSIVGSLERFSMTQNAVLMSLTAVKKLTGIKLTYGYLNGVPVNTHEDKPFTWYIYTRKNGKFE
DHPDGYFTQGRTTADFSPRSDMEKDFLSMDMGLFINKYGLEDYGFEHVVYGDVSKTTLGGLHLLISQVRLACMGVLKIDE
FVSSNDSTLKSCTVTYADNPSSKMVCTYMDLLLDDFVSILKSLDLSVVSKVHEVMVDCKMWRWMLWCKDHKLQTFYPQLQ
ASEWKCGYSMPSIYKIQRMCLEPCNLYNYGAGIKLPDGIMFNVVKYTQLCQYLNSTTMCVPHHMRVLHLGAGSDKGVAPG
TAVLRRWLPLDAIIVDNDSVDYVSDADYSVTGDCSTLYLSDKFDLVISDMYDGKIKSCDGENVSKEGFFPYINGVITEKL
ALGGTVAIKVTEFSWNKKLYELIQKFEYWTMFCTSVNTSSSEAFLIGVHYLGDFASGAVIDGNTMHANYIFWRNSTIMTM
SYNSVLDLSKFNCKHKATVVINLKDSSISDVVLGLLKNGKLLVRNNDAICGFSNHLVNVNK.

>USA/IL/2014/20697-P18R1 F6a Spike protein (SEQ ID NO:30)
MKSLNYFWLFLPVLSTLSLPQDVTRCQSTINFRRFFSKFNVQAPAVVLLGGYLPSMNSSSWYCGTGLETASGVHGIFLSY
IDAGQGFEIGISQEPFDPSGYQLYLHKATNGNHNAIARLRICQFPDNKTLGPTVNDVTTGRNCLFNKAIPAYMQDGKNIV
VGITWDNDRVTVFADKIYHFYLKNDWSRVATRCYNKRSCAMQYVYTPTYYMLNVTSAGEDGIYYEPCTANCSGYAANVFA
TDSNGHIPEGFSFNNWFLLSNDSTLLHGKVVSNQPLLVNCLLAIPKIYGLGQFFSFNQTMDGVCNGAAAQRAPEALRFNI
NDTSVILAEGSIVLHTALGTNLSFVCSNSSDPHLATFAIPLGATQVPYYCFLKVDTYNSTVYKFLAVLPPTVREIVITKY
GDVYVNGFGYLHLGLLDAVTINFTGHGTDDDVSGFWTIASTNFVDALIEVQGTAIQRILYCDDPVSQLKCSQVAFDLDDG
FYPISSRNLLSHEQPISFVTLPSFNDHSFVNITVSASFGGHSGANLIASDTTINGFSSFCVDTRQFTISLFYNVTNSYGY
VSKSQDSNCPFTLQSVNDYLSFSKFCVSTSLLASACTIDLFGYPEFGSGVKFTSLYFQFTKGELITGTPKPLEGVTDVSS
MTLDVCTKYTIYGFKGEGIITLTNSSFLAGVYYTSDSGQLLAFKNVTSGAVYSVTPCSFSEQAAYVDDDIVGVISSLSSS
TFNSTRELPGFFYHSNDGSNCTEPVLVYSNIGVCKSGSIGYVPSQSGQVKIAPTVTGNISIPTNFSMSIRTEYLQLYNTP
VSVDCATYVCNGNSRCKQLLTQYTAACKTIESALQLSARLESVEVNSMLTISEEALQLATISSFNGDGYNFTNVLGVSVY
DPASGRVVQKRSFIEDLLFNKVVTNGLGTVDEDYKRCSNGRSVADLVCAQYYSGVMVLPGVVDAEKLHMYSASLIGGMVL
GGFTSAAALPFSHAVQARLNYLALQTDVLQRNQQLLAESFNSAIGNITPAFESVKEAISQTSKGLNTVAHALTKVQEVVN
SQGAALTQLTVQLQHNFQAISSSIDDIYSRLDILSADVQVDRLITGRLSALNAFVAQTLTKYTEVQASRKLAQQKVNECV
KSQSQRYGFCGGDGEHIFSLVQAAPQGLLFLHTVLVPSDFVDVIAIAGLCVNDEIALTLREPGLVLFTHELQNHTATEYF
VSSRRMFEPRKPTVSDFVQIESCVVTYVNLTRDQLPDVIPDYIDVNKTLDEILASLPNRTGPSLPLDVFNATYLNLTGEI
ADLEQRSESLRNTTEELQSLIYNINNTLVDLEWLNRVETYIKWPWWVWLIIFIVLIFVVSLLVFCCISTGCCGCCGCCCA
CFSGCCRGPRLQPYEVFEKVHVQ.

>USA/IL/2014/20697-P18R1 F6a ORF3 protein (Truncated due to deletion/frameshift)(SEQ
ID NO:31)
MFLGLFQYTIDTVVKDVSKSANLSLDAVQELELNVVPIRQASNVTGFLFTSVFIYFFALFKASSLRRNYIMLAARFAVIV

Fig. 22C2

LYCPLLYYCGAFLDATIICCTLIGRLCLVCFYSWRYKNALFIIFNTTTLSFLNGKAALTANPL.

>USA/IL/2014/20697-P18R1 F6a Envelope protein (SEQ ID NO:32)
MLQLVNDNGLVVNVILWLFVLFFLLIISITFVQLVNLCFTCHRLCNSAVYTPIGRLYRVYKSYMQIDPLPSTVIDV.

>USA/IL/2014/20697-P18R1 F6a Membrane protein (SEQ ID NO:33)
MSNGSIPVDEVIQHLRNWNFTWNIILTILLVVLQYGHYKYSAFLYGVKMAILWILWPLVLALSLFDAWASFQVNWVFFAF
SILMACITLMLWIMYFVNSIRLWRRTHSWWSFNPETDALLTTSVMGRQVCIPVLGAPTGVTLTLLSGTLLVEGYKVATGV
QVSQLPNFVTVAKATTTIVYGRVGRSVNASSGTGWAFYVRSKHGDYSAVSNPSSVLTDSEKVLHLV.

>USA/IL/2014/20697-P18R1 F6a Nucleocapsid protein (SEQ ID NO:34)
MASVSFQDRGRKRVPLSLYAPLRVTNHKPLSKVLANNAVPTNKGNKDQQIGYWTEQIRWRMRRGERIEQPSNWHFYYLGT
GPHADLRYRTRTEGVFWVAKEGAKTEPTNLGVRKASEKPIIPNFSQQLPSVVEIVEPNTPPTSRANSRSRSRGNGNNRSR
SPSNNRGNNQSRGNSQNRGNNQGRGASQNRGGNNNNNNKSRNQSKNRNQSNDRGGVTSRDDLVAAVKDALKSLGIGENPD
KLKQQQKPKQERSDSSGKNTPKKNKSRATSKERDLKDIPEWRRIPKGENSVAACFGPRGGFKNFGDAEFVEKGVDASGYA
QIASLAPNVAALLFGGNVAVRELADSYEITYNYKMTVPKSDPNVELLVSQVDAFKTGNAKPQRKKEKKNKRETTQQLNEE
AIYDDVGVPSDVTHANLEWDTAVDGGDTAVEIINEIFDTGN.

Fig. 22C3

Fig. 23A1 >USA/IL/2014/20697-P8R1 complete genome (note: identical to passage 7R1)
(SEQ ID NO:35)
```
ACTTAAAAAGATTTTCTATCTACGGATAGTTAGCTCTTTTTCTAGACTCTTGTCTACTCAATTCAACTAAACGAAATTTT
GTCCTTCCGGCCGCATGTCCATGCTGCTGGAAGCTGACGTGGAATTTCATTAGGTTTGCTTAAGTAGCCATCGCAAGTGC
TGTGCTGTCCTCTAGTTCCTGGTTGGCGTTCCGTCGCCTTCTACATACTAGACAAACAGCCTTCCTCCGGTTCCGTCTGG
GGGTTGTGTGGATAACTAGTTCCGTCTAGTTTGAAACCAGTAACTGTCGGCTATGGCTAGCAACCATGTTACATTGGCTT
TTGCCAATGATGCAGAAATTTCAGCTTTTGGCTTTTGCACTGCTAGTGAAGCCGTCTCATACTATTCTGAGGCCGCCGCT
AGTGGATTTATGCAATGCCGTTTTGTGTCCTTCGATCTCGCTGACACTGTTGAGGGATTGCTTCCCGAAGACTATGTCAT
GGTGGTGGTCGGCACTACCAAGCTTAGTGCGTATGTGGACACTTTTGGTAGCCGCCCCAAAAACATTTGTGGTTGGCTGT
TATTTTCTAACTGTAATTACTTCCTCGAAGAGTTAGAGCTTACTTTTGGTCGTCGTGGTGGTAACATCGTGCCAGTTGAC
CAATACATGTGTGGCGCTGACGGTAAACCTGTTCTTCAGGAATCCGAATGGGAGTATACAGATTTCTTTGCTGACTCCGA
AGACGGTCAACTCAACATTGCTGGTATCACTTATGTGAAGGCCTGGATTGTAGAGCGATCGGATGTCTCTTATGCGAGTC
AGAATTTAACATCTATTAAGTCTATTACTTACTGTTCAACCTATGAGCATACTTTTCCTGATGGTACTGCCATGAAGGTT
GCACGTACTCCAAAGATTAAGAAGACTGTTGTCTTGTCTGAGCCACTTGCTACTATCTACAGGGAAATTGGTTCTCCTTT
TGTGGATAATGGGAGCGATGCTCGTTCTATCATTAAGAGACCAGTGTTCCTCCACGCTTTTGTTAAGTGTAAGTGTGGTA
GTTATCATTGGACTGTTGGTGATTGGACTTCCTATGTCTCCACTTGCTGTGGCTTTAAGTGTAAGCCAGTCCTTGTGGCT
TCATGCTCTGCTACGCCTGGTTCTGTTGTGGTTACGCGCGCTGGTGCTGGCACTGGTGTTAAGTATTACAACAACATGTT
CCTGCGCCATGTGGCAGACATTGATGGGTTGGCATTCTGGCGAATTCTCAAGGTGCAGTCCAAAGACGACCTCGCTTGCT
CTGGTAAATTCCTTGAACACCATGAGGAAGGTTTCACAGATCCTTGCTACTTTTTGAATGACTCGAGCATTGCTACTAAG
CTCAAGTTTGACATCCTTAGTGGCAAGTTTTCTGATGAAGTCAAACAAGCTATCTTTGCTGGTCATGTTGTTGTTGGCAG
CGCGCTCGTTGACATTGTTGACGATGCACTGGGACAGCCTTGGTTTATACGTAAGCTTGGTGACCTTGCAAGTGCAGCTT
GGGAGCAGCTTAAGGCTGTCGTTAGAGGCCTTAACCTCCTGTCTGATGAGGTCGTGCTCTTTGGCAAAAGACTTAGCTGT
GCCACTCTTAGTATCGTTAACGGTGTTTTTGAGTTCATCGCCGAAGTGCCTGAGAAGTTGGCTGCGGCTGTTACAGTTTT
TGTCAACTTCTTGAATGAGCTTTTTGAGTCTGCCTGTGACTGCTTAAAGGTCGGAGGTAAAACCTTTAACAAGGTTGGCT
CTTATGTTCTTTTTGACAACGCATTGGTTAAGCTTGTCAAGGCAAAAGTTCGCGGCCCACGACAGGCAGGTGTTTGTGAA
GTTCGTTACACAAGCCTTGTTATTGGGAGTACTACCAAGGTGGTTTCCAAGCGCGTTGAAAATGCCAATGTGAATCTCGT
CGTCGTTGACGAGGATGCGACCCTCAACACCACTGGTCGTACAGTTGTTGTTGACGGACTTGCATTCTTCGAGAGTGACG
GGTTTTACAGACATCTTGCTGATGCTGACGTTGTCATTGAACATCCTGTTTATAAGTCTGCTTGTGAGCTCAAGCCAGTT
TTTGAGTGTGACCCAATACCTGATTTTCCTATGCCTGTGGCCGCTAGTGTTGCAGAGCTTTGTGTGCAAACTGATCTGTT
GCTTAAAAATTACAACACTCCTTATAAAACTTACAGCTGCGTTGTGAGAGGTGATAAGTGTTGTATCACTTGTACCTTAC
ATTTCACAGCACCAAGTTATATGGAGGCTGCTGCTAATTTTGTAGACCTCTGTACCAAGAACATTGGTACTGCTGGTTTT
CATGAGTTTTACATTACGGCCCATGAACAACAGGATCTGCAAGGGTTTGTAACCACTTGTTGCACGATGTCAGGTTTTGA
GTGTTTTATGCCTATAATCCCACAGTGTCCAGCAGTGCTTGAAGAGATTGATGGTGGTAGCATCTGGCGGTCTTTTATCA
CTGGTCTTAATACAATGTGGGATTTTTGCAAGCATCTTAAAGTCAGCTTTGGACTAGATGGCATTGTTGTCACTGTAGCA
CGCAAATTTAAACGACTTGGTGCTCTCTTGGCAGAAATGTATAACACTTACCTTTCAACTGTGGTGGAAAACTTGGTACT
GGCCGGTGTTAGCTTCAAGTATTATGCCACCAGTGTCCCAAAAATTGTTTTGGGCTGTTGTTTTCACAGTGTTAAAGTG
TTCTTGCAAGTGCCTTCCAGATTCCTGTCCAGGCAGGCGTTGAGAAGTTTAAAGTCTTCCTTAACTGTGTTCACCCTGTT
GTACCACGTGTCATTGAAACTTCTTTTGTGGAATTAGAAGAGACGACATTTAAACCACCAGCACTCAATGGTAGTATTGC
TATTGTTGATGGCTTTGCTTTCTATTATGATGGAACACTATACTATCCCACCGATGGTAATAGCGTTGTTCCTATCTGCT
TTAAGAAGAAGGTGGTGGTGATGTCAAATTCTCTGATGAAGTCTCTGTTAAAACCATTGACCCAGTTTATAAGGTCTCC
CTTGAATTTGAGTTCGAGTCTGAGACTATTATGGCTGTGCTTAATAAGGCTGTTGGTAATTGTATCAAGGTTACAGGTGG
TTGGGACGATGTTGTTGAGTATATCAATGTTGCCATTGAGGTTCTTAAAGATCACATCGATGTGCCTAAGTACTACATCT
ATGATGAGGAAGGTGGCACCGATCCTAATCTGCCCGTAATGGTTTCTCAGTGGCCGTTGAATGATGACACGATCTCACAG
GATCTGCTTGATGTTGAAGTTGTTACTGATCGCCAGTTGATTCGAGGGTGATGAAGTAGACTCCTCTGACCCTGATAA
GGTGGCAGACGTGGCTAACTCTGAGCCTGAGGATGACGGTCTTAATGTAGCTCCTGAAACAAATGTAGAGTCTGAAGTTG
AGGAAGTTGCCGCAACCTTGTCCTTTATTAAAGATACACCTTCCACAGTTACTAAGGATCCTTTTGCTTTTGACTTTGCA
AGCTATGGAGGACTTAAGGTTTTAAGACAATCTCATAACAACTGCTGGGTTACTTCTACCTTGGTGCAGCTACAATTGCT
TGGCATCGTTGATGACCCTGCAATGGAGCTTTTTAGTGCTGGTAGAGTTGGTCCAATGGTTCGCAATGCTATGAGTCAC
AAAAGGCTATCTTGGGATCTTTGGGTGATGTGTCGGCTTGCCTAGAGTCTCTGACTAAGGACCTACACACACTTAAGATT
ACCTGTTCTGTAGTCTGTGGTTGTGGTACTGGTGAACGTATCTATGATGGTTGTGCTTTCGTATGACGCCAACTTTGGA
ACCGTTCCCATATGGTGCTTGTGCTCAGTGTGCTCAAGTTTTGATGCACACTTTTAAAAGTATTGTTGGCACCGGCATCT
TTTGTCGAGATACTACTGCTCTCCTTGGATTCTTGGTTGTAAAACCTCTTTGTGCGGCTGCTTTTATAGGCAAGGAT
AGTGGTCATTATGTCACTAACTTTTATGATGCTGTATTGATGGTTATGGTCGTCATCAGATAAAGTATGACAC
ACTGAACACTATTGTGTTAAAGACGTTAATTGGACGACACCTTTTGTCCCAGACGTTGAGCCTGTATTGGAGCTGTTG
TCAAACCTTTCTATTCTTATAAGAATGTTGATTTTACCAAGGAGATTTTAGTGACCTTGTTAAACTTCCATGTGATTTT
GTTGTTAATGCTGCAAATGAGAATTTGTCTCACGGTGGCGGCATAGCAAAGGCCATTGATGTTTATACCAGGGGCATGTT
GCAGAAGTGCTCGAATGATTACATTAAAGCACACGGTCCCATTAAAGTTGGACGTGGTGTCATGTTGGAGGCATTAGGTC
TTAAGGTCTTTAATGTTGTTGGTCCACGTAAGGGTAAGCATGCACCTGAGCTTCTTGTTAAGGCTTATAAGTCCGTTTTT
GCTAATTCAGGTGTTGCTCTTACACCTTTGATTAGTGTTGGAATTTTAGTGTTCCTTTGGAAGAATCTTTATCTGCTTT
TCTTGCATGTGTTGGTGATCGCCACTGTAAGTGCTTTTGTTATAGTGACAAAGAGCGCGAGGCGATCATTAATTACATGG
ATGGCTTGGTAGATGCTATTTTCAAAGATGCACTTGTTGATACTACTCCTGTCCAGGAAGATGTTCAACAAGTTTCACAA
```

```
AAACCAGTTTTGCCTAATTTTGAACCTTTCAGGATTGAAGGTGCTCATGCTTTCTATGAGTGCAACCCTGAAGGTTTGAT
GTCATTAGGTGCTGACAAGCTGGTGTTGTTTACAAATTCCAATTTGGATTTTTGTAGCGTTGGTAAGTGTCTTAACAATG
TGACTGGCGGTGCATTGCTTGAAGCCATAAATGTATTTAAAAAGAGTAACAAAACAGTGCCTGCTGGCAACTGTGTTACT
TTTGAGTGTGCAGATATGATTTCTATTACTATGGTAGTATTGCCATCTGACGGTGATGCTAATTATGACAAAAATTATGC
ACGCGCCGTCGTCAAGGTATCTAAGCTTAAAGGCAAGTTATTGCTTGCTGTTGGTGATGCCATGTTGGTGTATTCCAAGTTGT
CCCACCTCAGCGTGTTAGGTTTCGTATCCACACCTGATGATGTGGAGCGTTTCTACGCAAATAAGAGTGTGGTTATTAAA
GTTACTGAGGATACACGTAGTGTTAAGACTGTTAAAGTAGAATCCACTGTTACTTATGGACAACAAATTGGACCTTGTCT
TGTTAATGACACCGTTGTCACAGACAACAAACCTGTTGTTGCTGATGTTGTAGCTAAGGTTGTACCAAGTGCTAATTGGG
ATTCACATTATGGTTTTGATAAGGCTGGTGAGTTCCACATGCTAGACCATACTGGGTTTGCCTTTCCTAGTGAAGTTGTT
AACGGTAGGCGTGTGCTTAAAACCACAGATAATAACTGTTGGGTTAATGTTACATGTTTACAATTACAGTTTGCTAGATT
TAGGTTCAAGTCAGCAGGTCTACAGGCTATGTGGGAGTCCTATTGTACTGGTGATGTTGCTATGTTTGTGCATTGGTTGT
ACTGGCTTACTGGTGTTGACAAAGGTCAGCCTAGTGATTCAGAAAATGCACTTAACATGTTGTCTAAGTACATTGTTCCT
GCTGGTTCTGTCACTATTGAACGTGTCACGCATGACGGTTGTTGTTGTAGTAAGCGTGTTGTCACTGCACCAGTTGTGAA
TGCTAGCGTGTTGAAGCTTGGCGTCGAGGATGGTCTTTGTCCACATGGTCTTAACTACATTGACAAAGTTGTTGTAGTTA
AAGGTACTACAATTGTTGTCAATGTTGGAAAACCTGTAGTGGCACCATCGCACCTCTTTCTTAAGGGTGTTTCCTACACA
ACATTCCTAGATAATGGTAACGGTGTTGCCGGCCATTATACTGTTTTTGATCATGACACTGGTATGGTGCATGATGGAGA
TGTTTTTGTACCAGGTGATCTCAATGTGTCTCCTGTTACAAATGTTGTCGTCTCAGAGCAGACGGCTGTTGTGATTAAAG
ACCCTGTGAAGAAAGTAGAGTTAGACGCTACAAAGCTGTTAGACACTATGAATTATGCATCGGAAAGATTCTTTTCCTTT
GGTGATTTTATGTCACGTAATTTAATTACAGTGTTTTTGTACATCCTTAGTATTTTGGGTCTCTGTTTTAGGGCCTTTCG
TAAGAGGGATGTTAAAGTTCTAGCTGGTGTACCCCAACGTACTGGTATTATATTGCGTAAAAGTGTGCGCTATAATGCAA
AGGCTTTGGGTGTCTTCTTCAAGCTAAAACTTTATTGGTTCAAAGTTCTTGGTAAGTTTAGTTTGGGTATTTATGCATTG
TATGCATTACTATTCATGACAATACGCTTTACACCTATAGGTGGCCCTGTTTGTGATGATGTTGTTGCTGGTTATGCTAA
TTCTAGTTTTGACAAGAATGAGTATTGCAACAGTGTTATTTGTAAGGTCTGTCTCTATGGGTACCAGGAACTTTCGGACT
TCTCTCACACACAGGTAGTATGGCAACACCTTAGAGACCCATTAATTGGTAATGTGATGCCTTTCTTTTATTTGGCATTT
CTGGCAATTTTTGGGGGTGTTTATGTAAAGGCTATTACTCTCTATTTTATTTTCCAGTACCTTAACATTCTTGGTGTGTT
TTTGGGCCTACAACAGTCCATTTGGTTTTTGCAGCTTGTGCCTTTTGATGTCTTTGGTGACGAGATCGTCGTCTTTTTCA
TCGTTACACGCGTATTGATGTTCCTTAAGCATGTTTTCCTTGGCTGCGATAAGGCATCTTGTGTGGCTTGCTCTAAGAGT
GCTCGCCTTAAGCGCGTTCCTGTCCAGACTATTTTTCAGGGTACTAGCAAATCCTTCTACGTACATGCCAATGGTGGTTC
TAAGTTCTGTAAGAAGCACAATTTCTTTTGTTTAAATTGTGATTCTTATGGTCCAGGCTGACACTTTTATTAATGACGTCA
TTGCAACTGAAGTTGGTAATGTTGTCAAACTTAATGTGCAACCGACAGGTCCTGCCACTATTCTTATTGACAAGGTTGAA
TTCAGTAATGGTTTTTACTATCTTTATAGTGGTGACACATTTTGGAAGTACAACTTTGACATAACAGATAACAAATACAC
TTGCAAAGAGTCACTTAAAAATTGTAGCATAATCACAGACTTTATTGTTTTTAACAATAATGGTTCCAATGTAAATCAGG
TTAAGAATGCATGTGTGTATTTTTCACAGATGCTTTGTAAACCTGTTAAGTTAGTGGACTCAGCGTTGTTGGCCAGTTTG
TCTGTTGATTTTGGTGCAAGCTTACATAGTGCTTTTGTTAGTGTGTTGTCGAATAGTTTTGGCAAAGACCTGTCAAGTTG
TAATGACATGCAGGATTGCAAGAGCACATTGGGTTTTGATGATGTACCATTGGATACCTTTAATGCTGCTGTTGCTGAGG
CTCATCGTTACGATGTCCTCTTGACTGACATGTCGTTCAACAATTTTACCACCAGTTATGCAAAACCAGAGGAAAAACTT
CCCGTCCATGACATTGCCACGTGTATGCGTGTAGGTGCCAAGATTGTTAATCATAACGTTCTTGTCAAGGATAGTATACC
TGTGGTGTGGCTTGTACGTGATTTCATTGCCCTTTCTGAAGAAACTAGGAAGTACATTATTCGTACGACTAAAGTTAAGG
GTATAACCTTCATGTTGACCTTTAATGATTGTCGTATGCATACTACCATACCTACTGTTTGCATTGCAAATAAGAAGGGT
GCAGGTCTTCCTAGTTTTTCAAAGGTTAAGAAATTCTTCTGGTTTTTGTGTCTGTTCATAGTTGCTGTTTTCTTTGCACT
AAGCTTTTTGATTTTAGTACTCAGGTTAGCAGTGATAGTGATTATGACTTCAAGTATATTGAGAGTGGCCAGTTGAAGA
CTTTTGACAATCCACTTAGTTGTGTGCATAATGTCTTTAGTAACTTCGACCAGTGGCATGATGCCAAGTTTGGTTTCACC
CCCGTCAACAATCCTAGTTGTCCTATAGTCGTTGGTGTATCAGACGAAGCGCGCACTGTTCCAGGTATCCCAGCAGGTGT
TTATTTAGCTGGTAAAACACTTGTTTTTGCTATTAACACCATTTTGGTACATCTGGTTTGTGCTTTGATGCTAGTGGCG
TTGCTGATAAGGGCGCTTGCATTTTTAATTCGGCTTGCACCACATTATCTGGTTTGGGTGGACTGCTGTCTACTGTTAT
AAGAATGGTCTAGTTGAAGGTGCTAAACTTTATAGTGAGTTGGCACCTCATAGCTACTATATAAATGGTAGATGGTAATAC
TGTGTCTTTACCTGAAATTATCTCACGCGGCTTTGGCATCCGTACTATCCGTACAAAGGCTATGACCTACTGTCGCGTTG
GCCAGTGTGTGCAATCTGCAGAAGGTGTTTGTTTTGGCGCCGATAGATTCTTTGTCTATAATGCAGAATCGGTTCTGAC
TTTGTTTGTGGCACAGGGCTCTTTACATTGTTGATGAACGTTATTAGTGTTTTTTCCAAGACAGTACCAGTAACTGTGTT
GTCTGGTCAAATACTTTTTAATTGCATTATTGCTTTTGCTGCTGTTGCGGTGTGTTTCTTATTTACAAAGTTTAAGCGCA
TGTTCGGTGATATGTCTGTTGGCGTTTTCACTGTCGGTGCTTGTACTTTGTTGAACAATGTTTCCTACATTGTAACACAG
AACACACTTGGCATGTTGGGCTATGCAACTTTGTACTTTTTGTGCACTAAAGTGTTAGATATATGTGGATTTGGCATTT
GGGATTTTGATCTCATATATACTTATTGCACCATGGTGGGTTTTGATGGTTTATGCCTTTTCAGCCATTTTTGAGTTTA
TGCCTAACCTTTTTAAGCTTAAGGTTTCAACACAACTTTTTGAGGGTGACAAGTTCGTAGGCTCTTTTGAAAATGCTGCA
GCAGGTACATTTGTGCTTGATATGCATGCCTATGAGAGACTTGCCAACTCTATCTCAACTGAAAAACTGCGTCAGTATGC
TAGTACTTACAATAAGTACAAGTATTATTCAGGCAGTGCTTCAGAGGCTGATTACAGGCTTGCTTGTTTGCCCATTTGG
CCAAGGCTATGATGGATTATGCTTCTAATCACAACGACACGTTATACACACCACCCACTGTGAGTTACAATTCAACTCTA
CAGGCTGGCTTGCGTAAGATGGCACAACCATCTGGTGTTGTTGAGAAGTGCATAGTTCGTGTTTGCTATGGTAATATGGC
TCTTAATGGCCTATGGCTTGGTGATACTGTTATCTGCCCACGCCATGTTATAGCGTCTAGTACTACTAGCACTATAGATT
ATGACTATGCCCTTTCTGTTTTACGCCTCCACAACTTCTCCATTTCATCTGGTAATGTTTTCCTAGGTGTTGTGGGTGTA
ACCATGCGAGGTGCTTTGTTGCAGATAAAGGTTAATCAAAACAATGTCCACACGCCTAAGTACACCTATCGCACAGTTAG
ACCGGGTGAATCTTTTAATATCTTGGCGTGCTATGATGGTTCTGCAGCTGGTGTTTACGGCGTTAACATGCGCTCTAATT
ACACTATTAGAGGCTCGTTCATTAATGGCGCTTGTGGTTCACCTGGTTATAACATTAACAATGGTACCGTTGAGTTTTGC
```

```
TATTTACACCAGCTTGAACTTGGTTCAGGCTGTCATGTTGGTAGCGACTTAGATGGTGTTATGTATGGTGGTTATGAGGA
CCAACCTACTTTGCAAGTTGAAGGCGCTAGTAGTCTGTTTACAGAGAATGTGTTGGCATTTCTTTATGCAGCACTCATTA
ATGGTTCTACCTGGTGGCTTAGTTCTTCTAGGATTGCTGTAGACAGGTTTAATGAGTGGGCTGTTCATAATGGTATGACA
ACAGTAGTTAATACTGATTGCTTTTCTATTCTTGCTGCTAAGACTGGTGTTGATGTACAACGTTTGTTGGCCTCAATCCA
GTCTCTGCATAAGAATTTTGGTGGAAAGCAAATTCTTGGCTATACCTCGTTGACAGATGAGTTTACTACAGGTGAAGTTA
TACGTCAAATGTATGGCGTTAATCTTCAGATGGTTATGTTTCACGCGCCTGTAGAAATGTCTTGCTGGTTGGTTCTTTT
CTGACTTTCTTTTGGTCAGAATTAGTTTCCTACACTAAGTTCTTTTGGGTAAATCCTGGTTATGTCACACCTATGTTTGC
GTGTTTGTCATTGCTGTCCTCACTTTTGATGTTCACACTCAAGCATAAGACATTGTTTTTCCAGGTCTTTCTAATACCTG
CTCTGATTGTTACATCTTGCATTAATTTGGCATTTGATGTTGAAGTCTACAACTATTTGGCAGAGCATTTTGATTACCAT
GTTTCTCTCATGGGTTTTAATGCACAAGGTCTTGTTAACATCTTTGTCTGCTTTGTTGTTACCATTTTACACGGCACATA
CACATGGCGCTTTTTTAACACACCTGTGAGTTCTGTCACTTATGTGGTAGCTTTGCTGACTGCGGCATATAACTATTTTT
ACGCTAGTGACATTCTTAGTTGTGCTATGACACTATTTGCTAGTGTGACTGGCAACTGGTTCGTTGGTGCTGTTTGTTAT
AAAGCTGCTGTTTATATGGCCTTGAGATTTCCTACTTTTGTGGCTATTTTTGGTGATATTAAGAGTGTTATGTTCTGTTA
CCTTGTGTTGGGTTATTTTACCTGTTGCTTCTACGGTATTCTCTACTGGTTCAACAGGTTTTTAAGGTTAGTGTAGGTG
TCTATGACTATACTGTTAGTGCTGCTGAGTTTAAGTATATGGTTGCTAACGGCCTACGTGCACCAACTGGAACACTTGAT
TCACTACTTCTGTCTGCCAAATTGATTGGTATTGGTGGTGAGCGGAATATTAAGATTCTTCCGTTCAGTCTAAACTGAC
TGATATTAAGTGTAGTAACGTTGTGCTTTTAGGCTGTCTCTCTAGCATGAATGTTCAGCAAATTCAACAGAATGGGCCT
ATTGTGTTGACTTGCATAACAAGATCAACTTGTGTAATGACCCAGAAAAAGCGCAGGAAATGCTACTTGCTTTGTTGGCA
TTTTTCCTTAGTAAGAATAGTGCTTTTGGTTTAGATGACTTATTGGAATCCTATTTTAATGACAATAGTATGTTGCAGAG
TGTTGCATCTACTTATGTCGGTTTGCCTTCTTATGTCATTTATGAAAATGCACGCCAACAGTATGAAGATGCTGTTAATA
ATGGTTCTCCACCTCAGTTGGTTAAGCAATTGCGCCATGCCATGAATGTAGCAAAGAGCGAATTTGACCGTGAGGCTTCT
ACTCAGCGTAAGCTTGATAGAATGGCGGAACAGGCTGCAGCACAGATGTACAAAGAGGCACGAGCAGTTAATAGGAAGTC
CAAAGTTGTAAGTGCTATGCATTCACTGCTTTTGGTATGTTGAGACGTTTGGACATGTCTTCTGTAGACACCATTCTCA
ACTTGGCAAAGGATGGGGTTGTACCTCTGTCTGTCATACCGGCAGTCAGTGCTACTAAGCTTAACATTGTTACTTCTGAT
ATCGATTCTTATAATCGTATCCAGCGTGAGGGATGTGTCCACTACGCTGGTACCATTTGGAATATAATTGATATCAAGGA
CAATGATGGCAAGGTGGTACACGTTAAGGAGGTAACCGCACAGATGCTGAGTCCCTGTCATGGCCCCTGGTCCTTGGGT
GTGAGCGTATTGTCAAGCTCCAGAATAATGAAATTATTCCTGGTAAGCTGAAGCAGCGCTCCATTAAGGCAGAAGGAGAT
GGCATAGTTGGAGAAGGTAAGGCACTTTACAATAATGAGGGTGGACGTACTTTATGTATGCTTTCATCTCGGACAAACC
GGACCTGCGTGTAGTCAAGTGGGAGTTCGATGGTGGTTGTAACACTATTGAGCTAGAACCACCACGTAAGTTCTTGGTGG
ATTCTCCTAATGGTGCACAGATCAAGTATCTCTACTTTGTTCGTAACCTTAACACGTTACGTAGGGGTGCTGTTCTCGGC
TACATAGGTGCCACTGTACGCTTGCAGGCTGGTAAACAAACAGAACAGGCTATTAACTCTTCATTGTTGACACTTTGCGC
TTTCGCTGTGGATCCTGCTAAGACCTACATCGATGCTGTCAAAAGTGGTCACAAACCAGTAGGTAACTGTGTTAAGATGT
TGGCCAATGGTTCTGGTAATGGACAAGCTGTTACTAATGGTGTGGAGGCTAGTACTAACCAGGATTCATACGGTGGTGCG
TCCGTGTGTCTATATTGTAGAGCACATGTTGAGCATCCATCTATGGATGGTTTTTGCAGACTGAAAGGCAAGTACGTACA
GGTTCCACTAGGTACAGTGGATCCTATACGTTTTGTACTTGAGAATGACGTTTGCAAGGTTTGTGGTTGTTGGCTGGCTA
ATGGCTGCACTTGTGACAGATCCATTATGCAAAGCACTGATATGGCTTATTTAAACGAGTACGGGGCTCTAGTGCAGCTC
GACTAGAGCCCTGTAACGGTACTGATACACAACATGTGTATCGTGCTTTTGACATCTACAACAAGGATGTTGCTTGTCTA
GGTAAATTCCTCAAGGTGAACTGTGTTCGCCTGAAGAATTTGGATAAGCATGATGCATTCTATGTTGTCAAAAGATGTAC
CAAGTCTGCGATGGAACACGAGCAATCCATCTATAGCAGACTTGAAAAGTGTGGAGCCGTAGCCGAACACGATTTCTTCA
CTTGGAAGGATGGTCGTGCAATCTATGGTAACGTTTGTAGAAAGGATCTTACCGAGTATACTATGATGGATTTGTGTTAC
GCTTTACGTAACTTTGATGAAAACAATTGCGATGTTCTTAAGAGCATTTTAATTAAGGTAGGCGCTTGTGAGGAGTCCTA
CTTCAATAATAAAGTCTGGTTTGACCCTGTTGAAAATGAAGACATTCATCGTGTTTATGCATTGTTAGGTACCATTGTTT
CACGTGCTATGCTTAAATGCGTTAAGTTCTGTGATGCAATGGTTGAACAAGGTATAGTTGGTGTTGTCACATTAGATAAT
CAGGATCTTAATGGTGATTTTATGATTTTGGTGATTTTACTTGTAGCATCAAGGGAATGGGTATACCCATTTGCACATC
ATATTACTCTTATATGATGCCTGTTATGGGTATGACTAATTGCCTTGCTAGTGAGTGTTTTGTTAAGAGTGATATATTTG
GTGAGGATTTCAAGTCATATGACCTGCTGGAATATGATTTCACGGAGCATAAGACAGCACTCTTCAACAAGTATTTCAAG
TATTGGGGACTGCAATACCACCCTAACTGTGTGGACTGCAGTGAGCAGTGCATAGTTCACTGTGCCAATTTCAATAC
GTTGTTTTCCACTACTATACCTATTACGCGCATTTGGACCTTTGTGTCGCAAGTGTTGGATTGATGTGTTCCACTGGTAA
CTACAGCTGGTTATCATTTTAAACAGTTAGGTATAGTTTGGAACAATGACCTCAACTTACACTCTAGCAGGCTCTCTATT
AACGAACTACTCCAGTTTTGTAGTGATCCTGCATTGCTTATAGCATCATCACCAGCCCTTGTTGATCAGCGTACTGTTTG
CTTTTCAGTTGCAGCGCTAGGTACAGGTATGACTAACCAGACTGTTAAACCTGGCCATTTCAATAAGGAGTTTTATGACT
TCTTACTTGAGCAAGGTTTCTTTCTGAGGGCTCTGAGCTTACTTTAAAGCACTTCTTCTTTGCACAGAAGGGTGATGCA
GCTGTTAAGGATTTTGACTACTATAGGTATAATAGACCTACTGTTCTGGACATTTGCCAAGCTCGCGTCGTGTATCAAAT
AGTGCAACGCTATTTTGATATTTACGAAGGTGGTTGTATCACTGCTAAAGAAGTGGTTGTTACAAACCTTAACAAGAGCG
CAGGTTATCCTTTGAACAAGTTTGGTAAAGCTGGTCTTTACTATGAGTCTTTATCCTATGAGGAACAGGATGAACTTTAT
GCTTATACTAAGCGTAACATCCTGCCCACTATGACACAGCTCAACCTTAAATATGCTATAAGTGGCAAAGAACGTGCACG
CACAGTGGGTGGTGTTTCGCTTTGTCAACCATGACTACTCGGCAGTATCACCAGAAACACCTTAAGTCCATAGTTAATA
CTAGGGGCGCTTCGGTTGTTATTGGTACTACTAAGTTTTATGGTGGTTGGGACAATATGCTTAAGAACCTTATTGATGGT
GTCGAAAATCCGTGTCTTATGGGTTGGGATTACCCAAAGTGCGACAGAGCACTGCCCAATATGATACGCATGATTTCAGC
CATGATTTAGGCTCTAAGCACACCACATGCTGCAGTTCCACTGACCGCTTTTCAGGTTGTGCAATGAATTGGCTCAAG
TCCTTACTGAGGTTGTTTATTCTAATGGAGGTTTTTATTTGAAGCCAGGTGGTACTACCTCTGGTGATGCAACCACCGCA
TATGCAAACTCAGTTTTCAATATCTTCCAAGCAGTAAGTGCCAATGTTAATAAACTTCTTAGTGTTGACAGCAATGTCTG
TCATAATTTAGAAGTTAAGCAATTGCAGCGTAAGCTTTATGAGTGCTGTTATAGATCAACTACCGTTGATGACCAGTTCG
```

Fig. 23A3

```
TCGTTGAGTATTATGGTTACTTGCGTAAACATTTTTCAATGATGATTCTTTCTGATGATGGCGTTGTTTGTTACAACAAT
GACTATGCATCACTTGGTTATGTCGCTGATCTTAACGCATTCAAGGCTGTTTTGTATTACCAGAACAATGTCTTCATGAG
CGCCTCTAAATGTTGGATCGAGCCTGACATTAATAAAGGTCCTCATGAATTTTGCTCGCAGCATACTATGCAGATTGTCG
ATAAAGATGGTACTTACTACCTACCTTACCCTGATCCTTCAAGAATCCTCTCTGCAGGTGTGTTTGTTGACGACGTTGTT
AAAACTGATGCAGTTGTATTGCTTGAACGTTATGTGTCATTGGCTATAGATGCCTACCCGTTATCTAAGCATGAAAACCC
TGAATATAAGAAGGTGTTTTATGTGCTTTTGGATTGGGTTAAGCACCTGTATAAAACTTTGAATGCTGGTGTGTTAGAGT
CTTTTTCTGTCACACTTTTGGAAGATTCTACTGCTAAATTCTGGGATGAGAGCTTTTATGCCAACATGTATGAGAAATCT
GCAGTTTTGCAATCTGCAGGGCTTTGTGTTGTTTGTGGCTCTCAAACTGTTTTACGTTGTGGTGATTGTCTACGGCGTCC
TATGCTTTGTACTAAGTGTGCTTATGATCATGTCATTGGAACAACTCACAAGTTCATTTTGGCCATCACTCCATATGTGT
GTTGTGCTTCAGATTGTGGTGTCAATGATGTAACTAAGCTCTATTTAGGTGGTCTTAGTTATTGGTGTCATGACCACAAG
CCACGTCTTGCATTCCCGTTGTGCTCTGCTGGTAATGTTTTTGGCTTGTACAAAAATTCTGCTACCGGCTCACCCGATGT
TGAAGACTTTAATCGCATTGCTACATCCGATTGGACTGATGTTTCTGACTACAGGTTGGCAAATGATGTCAAGGACTCAT
TGCGTCTGTTTGCAGCGGAAACTATCAAGGCCAAGGAGGAGAGCGTTAAGTCATCCTATGCTTGTGCAACACTACATGAG
GTTGTAGGACCTAAAGAGTTGTTGCTCAAATGGGAAGTCGGCAGACCCAAACCACCCCTTAATAGAAATTCGGTTTTCAC
TTGTTATCATATAACGAAGAACACCAAATTTCAAATCGGTGAGTTTGTGTTTGAGAAGGCAGAATATGATAATGATGCTG
TAACATATAAAACTACCGCCACAACAAAACTTGTTCCTGGCATGGTTTTTGTGCTTACCTCACATAATGTTCAGCCATTG
CGCGCACCGACCATTGCTAACCAAGAACGTTATTCCACTATACATAAGTTGCATCCTGCTTTTAACATACCTGAAGCTTA
TTCTAGCTTAGTGCCCTATTACCAATTGATTGGTAAGCAGAAGATTACAACTATTCAGGGACCTCCCGGTAGTGGTAAAT
CTCACTGTGTTATAGGGCTAGGTTTGTACTATCCAGGTGCACGTATAGTGTTTACAGCTTGTTCTCATGCAGCGGTCGAT
TCACTTTGTGTGAAAGCTTCCACTGCTTATAGCAATGACAAATGTTCACGCATCATACCACAGCGCGCTCGTGTTGAGTG
TTATGATGGTTTCAAGTCTAATAATACTAGTGCTCAGTACCTTTTCTCTACTGTCAATGCTTTGCCAGAGTGCAATGCGG
ACATTGTTGTGGTGGATGAGGTCTCTATGTGCACTAATTATGACTTGTCTGTCATAAATCAGCGCATCAGCTATAGGCAT
GTAGTCTATGTTGGTGACCCTCAACAGCTGCCTGCACCACGTGTTATGATTTCACGTGGTACTTTGGAACCAAAGGACTA
CAACGTTGTCACTCAACGCATGTGTGCCCTTAAGCCTGATGTTTTCTTGCACAAGTGTTATCGCTGTCCTGCTGAGATAG
TGCGTACTGTGTCTGAGATGGTCTATGAAAACCAATTCATTCCTGTGCACCCAGATAGCAAGCAGTGTTTTAAAATCTTT
TGCAAGGGTAATGTTCAGGTTGATAATGGTTCAAGCATTAATCGCAGGCAATTGGATGTTGTGCGTATGTTTTTGGCTAA
AAATCCTAGGTGGTCAAAGGCTGTTTTTATTTCTCCTTATAACAGCCAGAATTATGTTGCCAGCCGCATGCTAGGTCTAC
AAATTCAGACAGTTGACTCATCCCAGGGTAGTGAGTATGACTATGTCATTTACACACAAACTTCAGATACTGCCCATGCC
TGTAATGTTAACAGGTTTAATGTTGCCATCACAAGGGCCAAGAAAGGCATATTATGTATAATGTGCGATAGGTCCCTTTT
TGATGTGCTTAAATTCTTTGAGCTTAAATTGTCTGATTTGCAGGCTAATGAGGGTTGTGGTCTTTTTAAAGACTGTAGCA
GAGGTGATGATCTGTTGCCACCATCTCACGCTAACACCTTCATGTCTTTAGCGGACAATTTTAAGACTGATCAAGATCTT
GCTGTTCAAATAGGTGTTAATGGACCCATTAAATATGAGCATGTTATCTCGTTTATGGGTTTCCGTTTTGATATCAACAT
ACCCAACCATCATACTCTCTTTTGCACACGCGACTTTGCCATGCGCAATGTTAGAGGTTGGTTAGGCTTTGACGTTGAAG
GAGCACATGTTGTTGGCTCTAACGTCGGTACAAATGTCCCATTGCAATTAGGGTTTTCTAACGGTGTTGATTTTGTTGTC
AGACCTGAAGGTTGCGTTGTAACAGAGTCTGGTGACTCACATTAAACCCGTCAGAGCTCGTGCTCCACCAGGGGAACAATT
CGCACACCTTTTGCCTTTACTTAAACGCGGCCAACCATGGGATGTTGTCCGCAAACGTATAGTGCAGATGTGTAGTGACT
ACCTGGCCAACCTATCAGACATACTAATTTTTGTGTTGTGGGCTGGTGGTTTGGAGTTGACAACTATGCGTTATTTTGTC
AAGATTGGACCAAGTAAGAGTTGTGATTGTGGTAAGGTTGCTACTTGTTACAATAGTGCGCTGCATACGTACTGTTGTTT
CAAACATGCCCTTGGTTGTGATTATCTGTATAACCCATACTGTATTGATATACAGCAGTGGGGATACAAGGGATCACTTA
GCCTTAACCACCATGAGCATTGTAATGTACATAGAAACGAGCATGTGGCTTCTGGTGATGCCATAATGACTCGCTGTCTG
GCCATACATGATTGCTTTGTCAAGAACGTTGACTGGTCCATCACATACCCATTTATTGGTAATGAGGCTGTTATTAATAA
GAGCGGCCGAATTGTGCAATCACACACTATGCGGTCAGTTCTTAAGTTATACAATCCGAAAGCCATATATGATATTGGCA
ATCCTAAGGGCATTAGATGTGCCGTAACGGATGCTAAGTGGTTTTGCTTTGACAAGAATCCTACTAATTCTAATGTCAAG
ACATTGGAGTATGACTATATAACACATGGCCAATTTGATGGGTTGTGCTTGTTTTGGAATTGCAATGTAGACATGTATCC
AGAATTTCTGTGGTCTGTCGTTTTGATACTCGCTGTAGGTCACCACTCAACTTGGAGGGTTGTAATGGTGGTTCACTGT
ATGTTAATAATCATGCATTCCATACACCGGCTTTTGACAAGCGTGCTTTTGCTAAGTTGAAGCCAATGCCATTTTTCTTT
TATGATGATACTGAGTGTGACAAGTTACAGGACTCCATAAACTGTTCCTCTTAGGGCTAGTAACTGCATTACTAAATG
TAATGTTGGTGCTGTCTGTAGTAAGCATTGTGTATGTATCATAGCTATGTTAATGCTTACAACACTTTTACGTCGG
CGGGCTTTACTATTGGGTGCCTACTTCGTTTGACACCTATAATCTGTGGCAGACATTTAGTAACAATTTGCAAGGTCTT
GAGAACATTGCTTTCAATGTCGTAAAGAAAGGATCTTTTGTTGGTGCCGAAGGTGAACTTCCTGTAGCTGTGGTTAATGA
CAAAGTGCTCGTTAGAGATGGTACTGTTGATACTCTTGTTTTTACAAACAAGACATCACTACCCACTAACGTAGCTTTTG
AGTTGTATGCCAAGCGTAAGGTAGGACTCACCCCCACCCATTACGATCCTACGTAACTTGGGTGTAGTTTGTACATCTAAG
TGTGTCATTTGGGACTATGAAGCCGAACGTCCACTTACTACTTTTACAAAGGATGTTTGTAAATATACCGACTTTGAGGG
TGACGTCTGTACACTCTTTGATAACAGCATTGTTGGTTCATTAGAGCGATTCTCCATGACCCAAAATGCTGTGCTTATGT
CACTTACAGCTGTTAAAAGCTTACTGGCATAAAGTAACTTATGGTTATCTTAATGGTGTCCCAGTTAACACATGAA
GATAAACCTTTTACTTGGTATATTTACACTAGGAAGAACGGCAAGTTCGAGGACCATCCTGATGGCTATTTTACCCAAGG
TAGAACAACCGCTGATTTTAGCCCTCGTAGCGACATGGAAAAGGACTTCCTAAGTATGGATATGGGTCTGTTTATTAACA
AGTACGGACTTGAAGATTACGGCTTTGAGCACGTTGTGTATGGTGATGTTTCAAAACCACCTTGGTGGTTTACATCTA
CTAATTTCGCAGGTGCGTCTGGCCTGTATGGGTGTGCTTAAAATAGACGAGTTTGTGTCTAGTAATGATAGCACGTTAAA
GTCTTGTACTGTTACATATGCTGATAACCCTAGTAGTAAGATGGTTTGCACGTATATGGATCTCCTTCTTGACGATTTTG
TCAGCATTCTTAAATCGTTGGATTTGAGTGTTGTATCTAAAGTTCATGAAGTTATGGTCGATTGTAAAATGTGGAGGTGG
ATGTTGTGGTGTAAGGATCATAAACTCCAGACATTTTATCCGCAACTTCAGGCCAGTGAATGGAAATGTGGTTATTCCAT
GCCTTCTATTTACAAGATACAACGTATGTGTTTAGAACCTTGCAACCTCTATAACTATGGTGCTGGTATTAAGTTACCTG
```

Fig. 23A4

```
ATGGCATTATGTTTAACGTAGTTAAATATACACAGCTTTGTCAATATCTTAATAGCACCACAATGTGTGTACCCCATCAC
ATGCGCGTGCTACATCTTGGTGCTGGCTCCGACAAGGGTGTTGCACCTGGCACGGCTGTCTTACGACGTTGGTTGCCACT
GGATGCCATTATAGTTGACAATGATAGTGTGGATTACGTTAGCGATGCTGATTATAGTGTTACGGGAGATTGCTCTACCT
TATACCTGTCAGATAAGTTTGACTTAGTTATATCTGATATGTATGATGGTAAGATTAAAAGTTGTGATGGGGAGAACGTG
TCTAAAGAAGGCTTCTTTCCCTATATTAATGGTGTCATCACTGAAAAGTTGGCACTTGGTGGTACTGTAGCTATTAAGGT
GACGGAGTTTAGTTGGAATAAGAAGTTGTATGAACTCATTCAGAAGTTTGAGTATTGGACAATGTTCTGTACCAGTGTTA
ACACGTCATCGTCAGAGGCATTTTTAATTGGTGTTCACTATTTAGGTGATTTTGCAAGTGGCGCTGTGATTGACGGCAAC
ACTATGCATGCCAATTATATCTTCTGGCGTAATTCCACAATTATGACTATGTCTTACAATAGTGTACTTGATTTAAGCAA
GTTCAATTGTAAGCATAAGGCTACAGTTGTTATTAATTTAAAAGATTCATCCATTAGTGATGTTGTGTTAGGTTTGTTGA
AGAATGGTAAGTTGCTAGTGCGTAATAATGACGCCATTTGTGGTTTTTCTAATCATTTGGTCAACGTAAACAAATGAAGT
CTTTAAATTACTTCTGGTTGTTCTTACCAGTACTTTCAACACTCAGCCTACCACAAGATGTCACTAGGTGCCAGTCCACT
ATTAACTTCAGGCGGTTCTTTTCAAAATTTAATGTGCAGGCACCTGCTGTCGTTTTGTTGGGTGGTTATCTACCTAGTAT
GAACTCCTCTAGCTGGTACTGTGGCACAGGTCTTGAAACTGCTAGTGGCGTGCATGGTATTTTCCTCAGTTACATCGATG
CTGGTCAGGGCTTTGAGATTGGCATTTCACAGGAGCCGTTTGATCCTAGTGGTTACCAGCTTTATTTACATAAGGCCACT
AATGGTAACCATAATGCTATTGCACGACTGCGCATTTGCCAGTTTCCAGATAATAAAACATTGGGCCCTACTGTTAATGA
TGTTACAACAGGTCGTAACTGCCTATTCAACAAGCCATTCCAGCTTATATGCAGGATGGAAAAATATCGTTGTCGGCA
TAACATGGGACAATGATCGTGTCACTGTTTTGCTGACAAGATCTATCATTTTATCTTAAAAATGATTGGTCCCGTGTT
GCGACAAGATGTTACAATAAAAGAAGTTGTGCTATGCAATATGTTTATACACCTACCTACTACATGCTTAATGTTACTAG
TGCAGGTGAGGATGGCATTTATTATGAACCATGTACAGCTAATTGCAGTGGTTACGCTGCCAATGTGTTTGCCACTGATT
CTAATGGCCACATACCAGAAGGTTTTAGTTTTAATAATTGGTTTCTTTTGTCCAATGATTCCACTTTGTTGCATGGTAAG
GTGGTTTCCAACCAACCTTTGTTGGTCAATTGTCTTTTGGCCATTCCTAAGATTTATGGACTAGGCCAATTTTTCTCATT
CAATCAAACGATGGATGGCGTTTGTAATGGAGCTGCTGCGCAGCGTGCACCAGAGGCTCTGAGGTTTAATATTAATGACA
CCTCTGTCATTCTTGCTGAAGGCTCAATTGTACTTCATACTGCTTTAGGAACAAATCTTTCTTTTGTTTGCAGTAATTCT
TCAGATCCTCATCTAGCTACCTTCGCCATACCTCTGGGTGCTACCCAAGTACCTTATTATTGTTTTCTTAAAGTGGATAC
TTACAACTCCACTGTTTATAAATTTTTGGCTGTTTTACCTCCTACCGTCAGGGAAATTGTCATCACCAAGTATGGTGATG
TTTATGTCAATGGGTTTGGATACTTGCATCTCGGTTTGTTGGATGCTGTCACAATTAATTTCACTGGTCATGGCACTGAC
GATGATGTTTCTGGTTTTTGGACCATAGCATCGACTAATTTTGTTGATGCACTCATCGAAGTTCAAGGAACCGCCATTCA
GCGTATTCTTTATTGTGATGATCCTGTTAGCCAACTCAAGTGTTCTCAGGTTGCTTTGACCTTGACGATGGTTTTTACC
CTATTTCTTCTAGAAACCTTCTGAGTCATGAACAGCCAATTTCTTTTGTTACTCTGCCATCATTTAATGATCATTCTTTT
GTTAACATTACTGTATCTGCTTCCTTTGGTGGTCATAGTGGTGCCAACCTTATTGCATCTGACACTACTATTAATGGGTT
TAGTTCTTTCTGTGTTGACACTAGACAATTTACCATTTCACTGTTTTATAACGTTACAAACAGTTATGGTTATGTGTCTA
AATCACAGGACAGTAATTGCCCCTTTCACCTTGCAATCTGTTAATGATTACCTGTCTTTTAGCAAATTTTGTGTTTCCACC
AGCCTTTTGGCTAGTGCCTGTACCATAGATCTTTTTGGTTACCCTGAGTTTGGTAGTGGTGTTAAGTTTACGTCCCTTTA
CTTTCAATTCACAAAGGGTGAGTTGATTACTGGCACGCCTAAACCACTTGAAGGTGTCACGGACGTTTCTTCTATGACTC
TGGATGTGTGTACCAAGTATACTATCTATGGCTTTAAAGGTGAGGGTATCATTACCCTTACAAATTCTAGCTTTTTGGCA
GGTGTTTATTACACATCTGATTCTGGACAGTTGTTAGCCTTTAAGAATGTCACTAGTGGTGCTGTTTATTCTGTTACGCC
ATGTTCTTTTTCAGAGCAGGCTGCATATGTTGATGATGATATAGTGGGTGTTATTCTAGTTTGTCTAGCTCCACTTTTA
ACAGTACTAGGGAGTTGCCTGGTTTCTTCTACCATTCTAATGATGGCTCTAATTGTACAGAGCCTGTGTTGGTGTATAGT
AACATAGGTGTTTGTAAATCTGGCAGTATTGGCTACGTCCCATCTCAGTCTGGTCAAGTCAAGATTGCACCCACGGTTAC
TGGGAATATTAGTATTCCCACCAACTTTAGTATGAGTATTAGGACAGAATATTTACAGCTTTACAACACGCCTGTTAGTG
TTGATTGTGCCACATATGTTTGTAATGGTAACTCTCGTTGTAAACAATTACTCACCCAGTACACTGCAGCATGTAAGACC
ATAGAGTCAGCATTACAACTCAGCGCTAGGCTTGAGTCTGTTGAAGTTAACTCTATGCTTACTATTTCTGAAGAGGCTCT
ACAGTTAGCTACCATTAGTTCGTTTAATGGTGATGGATATAATTTTACTAATGTGCTGGGTGTTTCTGTGTATGATCCTG
CAAGTGGCAGGGTGGTACAAAAAAGGTCTTTATTGAAGACCTGCTTTTAATAAAGTGGTTACTAATGGCCTTGGTACT
GTTGATGAAGACTATAAGCGCTGTTCTAATGGTCGCTCTGTGGCAGATCTAGTCTGTGCACAGTATTACTCTGGTGTCAT
GGTACTACCTGGTGTTGTTGACGCTGAGAAGCTTCACATGTATAGTGCGTCTCTCATCGGTGGTATGGTGCTAGGAGGTT
TTACTTCTGCAGCGGCCATTGCCTTTTAGCTATGCTGTTCAAGCTAGACTCAATTATCTTGCTCTACAGACGGATGTTCTA
CAGCGGAACCAGCAATTGCTTGCTGAGTCTTTTAACTCTGCTATTGGTAATATAACTCCAGCCTTTGAGAGTGTTAAAGA
GGCTATTAGTCAAACTTCCAAGGGGTTTGAACACTGTGGCTCATGCGCTTACTAAGGTTCAAGAGGTTGTTAACTCGCAGG
GTGCAGCTTTGACTCAACTTACCGTACAGCTGCAACACAACTTCCAAGCCATTTCTAGTTCTATTGATGACATTTACTCT
CGACTGGACATTCTTTCAGCCGATGTTCAGGTTGACCGTCTCATCACCGGCAGATTATCAGCACTTAATGCTTTTGTTGC
TCAAACCCTCACTAAGTATACTGAGGTTCAGGCTAGCAGGAAGTTAGCACAGCAAAAGGTTAATGAGTGCGTTAAATCGC
AATCTCAGCGTTATGGTTTTTGTGGTGGTGATGGCGAGCACATTTCTCTCTGGTACAGGCAGCACCTCAGGGCCTGCTG
TTTTTACATACAGTACTTGTACCGAGTGATTTGTAGATGTTATTGCCATCGCTGGCTTATGCGTTAACGATGAAATTGC
CTTGACTCTACGTGAGCCTGGCTTAGTCTTGTTTACGCATGAACTTCAAAATCATACTGCGACGGAATATTTTGTTTCAT
CGCGACGTATGTTTGAACCTAGAAAACCTACCGTTAGTGATTTTGTTCAAATTGAGAGTTGTGTGGTCACCTATGTCAAT
TTGACTAGAGACCAACTACCAGATGTAATCCCAGATTACATCGATGTTAACAAAACACTTGATGAGATTTAGCTTCTCT
GCCCAATAGAACTGGTCCAAGTCTTCCTTTAGATGTTTTTAATGCCACTTATCTTAATCTCACTGGTGAAATTGCAGATT
TAGAGCAGCGTTCAGAGTCTCTCCGTAATACTACAGAGGAGCTTCAAAGTCTTATATATAATATCAACAACACACTAGTT
GACCTTGAGTGGCTCAACCGAGTTGAGACATATATCAAGTGGCCGTGGTGGGTTTGGTTGATTATTTTCATTGTTCTCAT
CTTTGTTGTGTCATTACTAGTGTTCTGCTGCATTTCCACGGGTTGTTGTGGATGCTGCGGCTGCTGCTGTGCTTGTTTCT
CAGGTTGTTGTAGGGGTCCTAGACTTCAACCTTACGAAGTTTTTGAAAAGGTCCACGTGCAGTGATGTTTCTTGGACTTT
TTCAATACACGATTGACACAGTTGTCAAAGATGTCTCAAAGTCTGCTAACTTGTCTTTGGATGCTGTCCAAGAGTTGGAG
```

```
CTCAATGTAGTTCCAATTAGACAAGCTTCAAATGTGACGGGTTTTCTTTTCACCAGTGTTTTTATCTACTTCTTTGCACT
GTTTAAAGCGTCTTCTTTGAGGCGCAATTATATTATGTTGGCAGCGCGTTTTGCTGTCATTGTTCTTTATTGCCCACTTT
TATATTATTGTGGTGCATTTTTAGATGCAACTATTATTTGTTGCACACTTATTGGCAGGCTTTGTTTAGTCTGCTTTTAC
TCCTGGCGCTATAAAAATGCGCTCTTTATTATTTTTAATACTACGACACTTTCTTTCCTCAATGGTAAAGCAGCTTTGAC
GGCAAATCCATTGTGATTTTAGAAGGTGGTGACCATTACATCACTTTTGGCAACTCCTTTGTTGCTTTTGTTAGTAGCAT
CGACTTGTATCTAGCTATACGTGGGCGGCAAGAAGCTGACCTACAGCTGTTGCGAACTGTTGAGCTTCTTGATGGCAAGA
AGCTTTATGTCTTTTCGCAACATCAAATTGTTGGCATTACTAATGCTGCATTTGACTCAATTCAACTAGACGAGTATGCT
ACAATTAGTGAATGATAATGGTCTAGTAGTTAATGTTATACTTTGGCTTTTCGTACTCTTTTTCCTGCTTATTATAAGCA
TTACTTTCGTCCAATTGGTTAATCTGTGCTTCACTTGTCACCGGTTGTGTAATAGCGCAGTTTACACACCTATAGGGCGT
TTGTATAGAGTTTATAAGTCTTACATGCAAATAGACCCCCTCCCTAGTACTGTTATTGACGTATAAACGAAATATGTCTA
ACGGTTCTATTCCCGTTGATGAGGTGATTCAACACCTTAGAAACTGGAATTTCACATGGAATATCATACTGACGATACTA
CTTGTAGTGCTTCAGTATGGCCATTACAAGTACTCTGCGTTCTTGTATGGTGTCAAGATGGCTATTCTATGGATACTTTG
GCCTCTTGTGTTAGCACTGTCACTTTTTGATGCATGGGCTAGCTTTCAGGTCAATTGGGTCTTTTTTGCTTTCAGCATCC
TTATGGCTTGCATCACTCTTATGCTGTGGATAATGTACTTTGTCAATAGCATTCGGTTGTGGCGCAGGACACATTCTTGG
TGGTCTTTCAATCCTGAAACAGACGCGCTTCTCACTACTTCTGTGATGGGCCGACAGGTCTGCATTCCAGTGCTTGGAGC
ACCAACTGGTGTAACGCTAACACTCCTTAGTGGTACATTGCTTGTAGAGGGCTATAAGGTTGCTACTGGCGTACAGGTAA
GTCAATTACCTAATTTCGTCACAGTCGCCAAGGCCACTACAACAATTGTCTACGACGTGTTGGTCGTTCAGTCAATGCT
TCATCTGGCACTGGTTGGGCTTTCTATGTCCGGTCCAAACACGGCGACTACTCAGCTGTGAGTAATCCGAGTTCGGTTCT
CACAGATAGTGAGAAAGTGCTTCATTTAGTCTAAACAGAAACTTTATGGCTTCTGTCAGTTTTCAGGATCGTGGCCGCAA
ACGGGTGCCATTATCCCTCTATGCCCCTCTTAGGGTTACTAATCACAAACCCCTTTCTAAGGTACTTGCAAATAATGCTG
TACCCACTAATAAAGGAAATAAGGACCAGCAAATTGGATACTGGACTGAGCAAATTCGCTGGCGCATGCGCCGTGGTGAG
CGAATTGAACAACCTTCCAATTGGCATTTCTACTACCTCGGAACAGGACCTCACGCCGACCTCCGCTATAGGACTCGTAC
TGAGGGTGTTTTCTGGGTTGCTAAAGAAGGCGCAAAGACTGAACCCACTAACCTGGGTGTCAGAAAGGCGTCTGAAAAGC
CAATTATTCCAAATTTCTCTCAACAGCTTCCCAGCGTAGTTGAGATTGTTGAACCTAACACACCTCCTACTTCACGTGCA
AATTCACGTAGCAGGAGTCGTGGTAATGGCAACAACAGGTCCAGATCTCCAAGTAACAACAGAGGCAATAACCAGTCCCG
CGGTAATTCACAGAATCGTGGAAATAACCAGGGTCGTGGAGCTTCTCAGAACAGAGGAGGCAATAATAATAACAATAACA
AGTCTCGTAACCAGTCCAAGAACAGAACCAGTCAAATGACCGTGGTGGTGTAACATCACGCGATGATCTGGTGGCTGCT
GTCAAGGATGCCCTTAAATCTTTGGGTATTGGCGAAAACCCTGACAAGCTTAAGCAACAGCAGAAGCCCAAACAGGAAAG
GTCTGACAGCAGCGGCAAAAATACACCTAAGAAGAACAAATCCAGAGCCACTTCGAAAGAACGTGACCTCAAAGACATCC
CAGAGTGGAGGAGAATTCCCAAGGGCGAAAATAGCGTAGCAGCTTGCTTCGGACCCAGGGGAGGCTTCAAAAATTTTGGA
GATGCGGAATTTGTCGAAAAAGGTGTTGATGCCTCAGGCTATGCTCAGATCGCCAGTTTAGCACCGAATGTTGCAGCATT
GCTCTTTGGTGGTAATGTGGCTGTTCGTGAGCTAGCGGACTCTTACGAGATTACATATAATTATAAAATGACTGTGCCAA
AGTCTGATCCAAATGTAGAGCTTCTTGTTTCACAGGTGGATGCATTTAAAACTGGGAATGCAAAACCCCAGAGAAAGAAG
GAAAAGAAGAACAAGCGTGAAACCACGCAGCAGCTGAATGAAGAGGCCATCTACGATGATGTGGGTGTGCCATCTGATGT
GACTCATGCCAATTTGGAATGGGACACAGCTGTTGATGGTGGTGACACGGCCGTTGAAATTATCAACGAGATCTTCGACA
CAGGAAATTAAACAATGTTTGACTGGCTTATCCTGGCTATGTCCCAGGGTAGTGCCATTACACTGTTATTACTGAGTGTT
TTTCTAGCGACTTGGCTGCTGGGCTATGGCTTTGCCCTCTAACTAGCGGTCTTGGTCTTGCACACAACGGTAAGCCAGTG
GTAATGTCAGTGCAAGAAGGATATTACCATAGCACTGTCATGAGGGGAACGCAGTACCTTTTCATCTAAACCTTTGCACG
AGTAATCAAAGATCCGCTTGACGAGCCTATATGGAAGAGCGTGCCAGGTATTTGACTCAAGGACTGTTAGTAACTGAAGA
CCTGACGGTGTTGATATGGATACAC
```

Fig. 23A6

FIG. 23B1 >USA/IL/2014/20697-P18R1 G8b complete genome (SEQ ID NO:36)

```
ACTTAAAAAGATTTTCTATCTACGGATAGTTAGCTCTTTTTCTAGACTCTTGTCTACTCAATTCAACTAAACGAAATTTT
GTCCTTCCGGCCGCATGTCCATGCTGCTGGAAGCTGACGTGGAATTTCATTAGGTTTGCTTAAGTAGCCATCGCAAGTGC
TGTGCTGTCCTCTAGTTCCTGGTTGGCGTTCCGTCGCCTTCTACATACTAGACAAACAGCCTTCCTCCGGTTCCGTCTGG
GGGTTGTGTGGATAACTAGTTCCGTCTAGTTTGAAACCAGTAACTGTCGGCTATGGCTAGCAACCATGTTACATTGGCTT
TTGCCAATGATGCAGAAATTTCAGCTTTTGGCTTTTGCACTGCTAGTGAAGCCGTCTCATACTATTCTGAGGCCGCCGCT
AGTGGATTTATGCAATGCCGTTTTGTGTCCTTCGATCTCGCTGACACTGTTGAGGGATTGCTTCCCGAAGACTATGTCAT
GGTGGTGGTCGGCACTACCAAGCTTAGTGCGTATGTGGACACTTTTGGTAGCCGCCCCAAAAACATTTGTGGTTGGCTGT
TATTTTCTAACTGTAATTACTTCCTCGAAGAGTTAGAGCTTACTTTTGGTCGTCGTGGTGGTAACATCGTGCCAGTTGAC
CAATACATGTGTGGCGCTGACGGTAAACCTGTTCTTCAGGAATCCGAATGGGAGTATACAGATTTCTTTGCTGACTCCGA
AGACGGTCAACTCAACATTGCTGGTATCACTTATGTGAAGGCCTGGATTGTAGAGCGATCGGATGTCTCTTATGCGAGTC
AGAATTTAACATCTATTAAGTCTATTACTTACTGTTCAACCTATGAGCATACTTTTCCTGATGGTACTGCCATGAAGGTT
GCACGTACTCCAAAGATTAAGAAGACTGTTGTCTTGTCTGAGCCACTTGCTACTATCTACAGGGAAATTGGTTCTCCTTT
TGTGGATAATGGGAGCGATGCTCGTTCTATCATTAAGAGACCAGTGTTCCTCCACGCTTTTGTTAAGTGTAAGTGTGGTA
GTTATCATTGGACTGTTGGTGATTGGACTTCCTATGTCTCCACTTGCTGTGGCTTTAAGTGTAAGCCAGTCCTTGTGGCT
TCATGCTCTGCTACGCCTGGTTCTGTTGTGGTTACGCGCGCTGGTGCTGGCACTGGTGTTAAGTATTACAACAACATGTT
CCTGCGCCATGTGGCAGACATTGATGGGTTGGCATTCTGGCGAATTCTCAAGGTGCAGTCCAAAGACGACCTCGCTTGCT
CTGGTAAATTCCTTGAACACCATGAGGAAGGTTTCACAGATCCTTGCTACTTTTGAATGACTCGAGCATTGCTACTAAG
CTCAAGTTTGACATCCTTAGTGGCAAGTTTTCTGATGAAGTCAAACAAGCTATCTTTGCTGGTCATGTTGTTGTTGGCAG
CGCGCTCGTTGACATTGTTGACGATGCACTGGGACAGCCTTGGTTTATACGTAAGCTTGGTGACCTTGCAAGTGCAGCTT
GGGAGCAGCTTAAGGCTGTCGTTAGAGGCCTTAACCTCCTGTCTGATGAGGTCGTGCTCTTTGGCAAAAGACTTAGCTGT
GCCACTCTTAGTATCGTTAACGGTGTTTTTGAGTTCATCGCCGAAGTGCCTGAGAAGTTGGCTGCGGCTGTTACAGTTTT
TGTCAACTTCTTGAATGAGCTTTTTGAGTCTGCCTGTGACTGCTTAAAGGTCGGAGGTAAAACCTTTAACAAGGTTGGCT
CTTATGTTCTTTTTGACAACGCATTGGTTAAGCTTGTCAAGGCAAAAGTTCGCGGCCCACGACAGGCAGGTGTTTGTGAA
GTTCGTTACACAAGCCTTGTTATTGGGAGTACTACCAAGGTGGTTTCCAAGCGCGTTGAAAATGCCAATGTGAATCTCGT
CGTCGTTGACGAGGATGCGACCCTCAACACCACTGGTCGTACAGTTGTTGTTGACGGACTTGCATTCTTCGAGAGTGACG
GGTTTTACAGACATCTTGCTGATGCTGACGTTGTCATTGAACATCCTGTTTATAAGTCTGCTTGTGAGCTCAAGCCAGTT
TTTGAGTGTGACCCAATACCTGATTTTCCTATGCCTGTGGCCGCTAGTGTTGCAGAGCTTTGTGTGCAAACTGATCTGTT
GCTTAAAAATTACAACACTCCTTATAAAACTTACAGCTGCGTTGTGAGAGGTGATAAGTGTTGTATCACTTGTACCTTAC
ATTTCACAGCACCAAGTTATATGGAGGCTGCTGCTAATTTTGTAGACCTCTGTACCAAGAACATTGGTACTGCTGGTTTT
CATGAGTTTTACATTACGGCCCATGAACAACAGGATCTGCAAGGGTTTGTAACCACTTGTTGCACGATGTCAGGTTTTGA
GTGTTTTATGCCTATAATCCCACAGTGTCCAGCAGTGCTTGAAGAGATTGATGGTGGTAGCATCTGGCGGTCTTTTATCA
CTGGTCTTAATACAATGTGGGATTTTTGCAAGCATCTTAAAGTCAGCTTTGGACTAGATGGCATTGTTGTCACTGTAGCA
CGCAAATTTAAACGACTTGGTGCTCTCTTGGCAGAAATGTATAACACTTACCTTTCAACTGTGGTGGAAAACTTGGTACT
GGCCGGTGTTAGCTTCAAGTATTATGCCACCAGTGTCCCAAAAATTGTTTTGGGCTGTTGTTTTCACAGTGTTAAAAGTG
TTCTTGCAAGTGCCTTCCAGATTCCTGTCCAGGCAGGCGTTGAGAAGTTTAAAGTCTTCCTTAACTGTGTTCACCCTGTT
GTACCACGTGTCATTGAAACTTCTTTTGTGGAATTAGAAGAGACGACATTTAAACCACCAGCACTCAATGGTAGTATTGC
TATTGTTGATGGCTTTGCTTTCTATTATGATGGAACACTATACTATCCCACCGATGGTAATAGCGTTGTTCCTATCTGCT
TTAAGAAGAAGGTGGTGGTGATGTCAAATTCTCTGATGAAGTCTCTGTTAAAACCATTGACCCAGTTTATAAGGTCTCC
CTTGAATTTGAGTTCGAGTCTGAGACTATTATGGCTGTGCTTAATAAGGCTGTTGGTAATTGTATCAAGGTTACAGGTGG
TTGGGACGATGTTGTTGAGTATATCAATGTTGCCATTGAGGTTCTTAAAGATCACATCGATGTGCCTAAGTACTACATCT
ATGATGAGGAAGGTGGCACCGATCCTAATCTGCCCGTAATGGTTTCTCAGTGGCCGTTGAATGATGACACGATCTCACAG
GATCTGCTTGATGTTGAAGTTGTTACTGATGCGCCAGTTGATTTCGAGGGTGATGAAGTAGACTCCTCTGACCCTGATAA
GGTGGCAGACGTGGCTAACTCTGAGCCTGAGGATGACGGTCTTAATGTAGCTCCTGAAACAAATGTAGAGTCTGAAGTTG
AGGAAGTTGCCGCAACCTTGTCCTTTATTAAAGATACACCTTCCACAGTTACTAAGGATCCTTTTGCTTTGACTTTGCA
AGCTATGGAGGACTTAAGGTTTTAAGACAATCTCATAACAACTGCTGGGTTACTTCTACCTTGGTGCAGCTACAATGCT
TGGCATCGTTGATGACCCTGCAATGGAGCTTTTTAGTGCTGGTAGAGTTGGTCCAATGGTTCGCAAATGCTATGAGTCAC
AAAAGGCTATCTTGGGATCTTTGGGTGATGTGTCGGCTTGCCTAGAGTGTTCTGACTAAGGACCTACACACACTTAAGATT
ACCTGTTCTGTAGTCTGTGGTTGTGGTACTGGTGAACGTATCTATGATGGTTGTGCTTTTCGTATGACGCCAACTTTGGA
ACCGTTCCCATATGGTGCTTGTGCTCAGTGTGCTCAAGTTTTGATGCACACTTTTAAAAGTATTGTTGGCACCGGCATCT
TTTGTCGAGATACTACTGCTCTCTCCTTGGATTCTTTGGTTGTAAAACCTCTTTGTGCGGCTGCTTTTATAGGCAAGGAT
AGTGGTCATTATGTCACTAACTTTTATGATGCTGCTATGGCTATTGATGGTTATGGTCGTCATCAGATAAAGTATGACAC
ACTGAACACTATTTGTGTTAAAGACGTTAATTGGACAGCACCTTTTGTCCCAGACGTTGAGCCTGTATTGGAGCCTGTTG
TCAAACCTTTCTATTCTTATAAGAATGTTGATTTTTACCAAGGAGATTTTAGTGACCTTGTTAAACTTCCATGTGATTTT
GTTGTTAATGCTGCAAATGAGAATTTGTCTCACGGTGGCGGCATAGCAAAGGCCATTGATGTTTATACCAGGGGCATGTT
GCAGAAGTGCTCGAATGATTACATTAAAGCACACGGTCCCATTAAAGTTGGACGTGGTGTCATGTTGGAGGCATTAGGTC
TTAAGGTCTTTAATGTTGTTGGTCCACGTAAGGGTAAGCATGCACCTGAGCTTCTTGTTAAGGCTTATAAGTCCGTTTTT
GCTAATTCAGGTGTTGCTCTTACACCTTTGATTAGTGTTGGAATTTTTAGTGTTCCTTGGAAGAATCTTTATCTGCTTT
TCTTGCATGTGTTGGTGATCGCCACTGTAAGTGCTTTTGTTATAGTGACAAAGAGCGCGAGGCGATCATTAATTACATGG
ATGGCTTGGTAGATGCTATTTTCAAAGATGCACTTGTTGATACTACTCCTGTCCAGGAAGATGTTCAACAAGTTTCACAA
AAACCAGTTTTGCCTAATTTTGAACCTTTCAGGATTGAAGGTGCTCATGCTTTCTATGAGTGCAACCCTGAAGGTTTGAT
GTCATTAGGTGCTGACAAGCTGGTGTTGTTTACAAATTCCAATTTGGATTTTGTAGCGTTGGTAAGTGTCTTAACAATG
TGACTGGCGGTGCATTGCTTGAAGCCATAAATGTATTTAAAAAGAGTAACAAAACAGTGCCTGCTGGCAACTGTGTTACT
```

```
TTTGAGTGTGCAGATATGATTTCTATTACTATGGTAGTATTGCCATCTGACGGTGATGCTAATTATGACAAAAATTATGC
ACGCGCCGTCGTCAAGGTATCTAAGCTTAAAGGCAAGTTATTGCTTGCTGTTGGTGATGCCATGTTGTATTCCAAGTTGT
CCCACCTCAGCGTGTTAGGTTTCGTATCCACACCTGATGATGTGGAGCGTTTCTACGCAAATAAGAGTGTGGTTATTAAA
GTTACTGAGGATACACGTAGTGTTAAGACTGTTAAAGTAGAATCCACTGTTACTTATGGACAACAAATTGGACCTTGTCT
TGTTAATGACACCGTTGTCACAGACAACAAACCTGTTGTTGCTGATGTTGTAGCTAAGGTTGTACCAAGTGCTAATTGGG
ATTCACATTATGGTTTTGATAAGGCTGGTGAGTTCCACATGCTAGACCATACTGGGTTTGCCTTTCCTAGTGAAGTTGTT
AACGGTAGGCGTGTGCTTAAAACCACAGATAATAACTGTTGGGTTAATGTTACATGTTTACAATTACAGTTTGCTAGATT
TAGGTTCAAGTCAGCAGGTCTACAGGCTATGTGGGAGTCCTATTGTACTGGTGATGTTGCTATGTTTGTGCATTGGTTGT
ACTGGCTTACTGGTGTTGACAAAGGTCAGCCTAGTGATTCAGAAAATGCACTTAACATGTTGTCTAAGTACATTGTTCCT
GCTGGTTCTGTCACTATTGAACGTGTCACGCATGACGGTTGTTGTTGTAGTAAGCGTGTTGTCACTGCACCAGTTGTGAA
TGCTAGCGTGTTGAAGCTTGGCGTCGAGGATGGTCTTTGTCCACATGGTCTTAACTACATTGACAAAGTTGTTGTAGTTA
AAGGTACTACAATTGTTGTCAATGTTGGAAAACCTGTAGTGGCACCATCGCACCTCTTTCTTAAGGGTGTTTCCTACACA
ACATTCCTAGATAATGGTAACGGTGTTGCCGGCCATTATACTGTTTTTGATCATGACACTGGTATGGTGCATGATGGAGA
TGTTTTTGTACCAGGTGATCTCAATGTGTCTCCTGTTACAAATGTTGTCGTCTCAGAGCAGACGGCTGTTGTGATTAAAG
ACCCTGTGAAGAAAGTAGAGTTAGACGCTACAAAGCTGTTAGACACTATGAATTATGCATCGGAAAGATTCTTTTCCTTT
GGTGATTTTATGTCACGTAATTTAATTACAGTGTTTTTGTACATCCTTAGTATTTTGGGTCTCTGTTTTAGGGCCTTTCG
TAAGAGGGATGTTAAAGTTCTAGCTGGTGTACCCCAACGTACTGGTATTATATTGCGTAAAAGTGTGCGCTATAATGCAA
AGGCTTTGGGTGTCTTCTTCAAGCTAAAACTTTATTGGTTCAAAGTTCTTGGTAAGTTTAGTTTGGGTATTTATGCATTG
TATGCATTACTATTCATGACAATACGCTTTACACCTATAGGTGGCCCTGTTTGTGATGATGTTGTTGCTGGTTATGCTAA
TTCTAGTTTTGACAAGAATGAGTATTGCAACAGTGTTATTTGTAAGGTCTGTCTCTATGGGTACCAGGAACTTTCGGACT
TCTCTCACACACAGGTAGTATGGCAACACCTTAGAGACCCATTAATTGGTAATGTGATGCCTTTCTTTTATTTGGCATTT
CTGGCAATTTTTGGGGGTGTTTATGTAAAGGCTATTACTCTCTATTTTATTTTCCAGTACCTTAACATTCTTGGTGTGTT
TTTGGGCCTACAACAGTCCATTTGGTTTTTGCAGCTTGTGCCTTTTGATGTCTTTGGTGACGAGATCGTCGTCTTTTTCA
TCGTTACACGCGTATTGATGTTCCTTAAGCATGTTTTCCTTGGCTGCGATAAGGCATCTTGTGTGGCTTGCTCTAAGAGT
GCTCGCCTTAAGCGCGTTCCTGTCCAGACTATTTTTCAGGGTACTAGCAAATCCTTCTACGTACATGCCAATGGTGGTTC
TAAGTTCTGTAAGAAGCACAATTTCTTTTGTTTAAATTGTGATTCTTATGGTCCAGGCTGCGCACTTTTATTAATGACGTCA
TTGCAACTGAAGTTGGTAATGTTGTCAAACTTAATGTGCAACCGACAGGTCCTGCCACTATTCTTATTGACAAGGTTGAA
TTCAGTAATGGTTTTTACTATCTTTATAGTGGTGACACATTTTGGAAGTACAACTTTGACATAACAGATAACAAATACAC
TTGCAAAGAGTCACTTAAAAATTGTAGCATAATCACAGACTTTATTGTTTTTAACAATAATGGTTCCAATGTAAATCAGG
TTAAGAATGCATGTGTGTATTTTTCACAGATGCTTTGTAAACCTGTTAAGTTAGTGGACTCAGCGTTGTTGGCCAGTTTG
TCTGTTGATTTTGGTGCAAGCTTACATAGTGCTTTTGTTAGTGTGTTGTCGAATAGTTTTGGCAAAGACCTGTCAAGTTG
TAATGACATGCAGGATTGCAAGAGCACATTGGGTTTTGATGATGTACCATTGGATACCTTTAATGCTGCTGTTGCTGAGG
CTCATCGTTACGATGTCCTCTTGACTGACATGTCGTTCAACAATTTTACCACCAGTTATGCAAAACCAGAGGAAAAACTT
CCCGTCCATGACATTGCCACGTGTATGCGTGTAGGTGCCAAGATTGTTAATCATAACGTTCTTGTCAAGGATAGTATACC
TGTGGTGTGGCTTGTACGTGATTTCATTGCCCTTTCTGAAGAAACTAGGAAGTACATTATTCGTACGACTAAAGTTAAGG
GTATAACCTTCATGTTGACCTTTAATGATTGTCGTATGCATACTACCATACCTACTGTTTGCATTGCAAATAAGAAGGGT
GCAGGTCTTCCTAGTTTTTCAAAGGTTAAGAAATTCTTCTGGTTTTTGTGTCTGTTCATAGTTGCTGTTTTCTTTGCACT
AAGCTTTTTTGATTTTAGTACTCAGGTTAGCAGTGATAGTGATTATGACTTCAAGTATATTGAGAGTGGCCAGTTGAAGA
CTTTTGACAATCCACTTAGTTGTGTGCATAATGTCTTTAGTAACTTCGACCAGTGGCATGATGCCAAGTTTGGTTTCACC
CCCGTCAACAATCCTAGTTGTCCTATAGTCGTTGGTGTATCAGACGAAGCGCGCACTGTTCCAGGTATCCCAGCAGGTGT
TTATTTAGCTGGTAAAACACTTGTTTTTGCTATTAACACCATTTTTGGTACATCTGGTTTGTGCTTTGATGCTAGTGGCG
TTGCTGATAAGGGCGCTTGCATTTTAATTCGGCTTGCACCACATTATCTGGTTTGGGTGGAACTGCTGTCTACTGTTAT
AAGAATGGTCTAGTTGAAGGTGCTAAACTTTATAGTGAGTTGGCACCTCATAGCTACTATAAAATGGTAGATGGTAATAC
TGTGTCTTTACCTGAAATTATCTCACGCGGCTTTGGCATCCGTACTATCCGTACAAAGGCTATGACCTACTGTCGCGTTG
GCCAGTGTGTGCAATCTGCAGAAGGTGTTTGTTTGGCGCCGATAGATTCTTTGTCTATAATGCAGAATCTGGTTCTGAC
TTTGTTTGTGGCACAGGGCTCTTTACATTGTTGATGAACGTTATTAGTGTTTTTTCCAAGACAGTACCAGTAACTGTGTT
GTCTGGTCAAATACTTTTAATTGCATTATTGCTTTGCTGCTGTTGCCGGTGTGTTTCTTATTTACAAAGTTTAAGCGCA
TGTTCGGTGATATGTCTTGGCGTTTCACTGTCGGTGCTTGTACTTGTTGAACAATGTTTCCTACATTGTAACACAG
AACACACTTGGCATGTTGGGCTATGTCAACTTTGTACTTTTGTGCACTAAAGGTGTTAGATATATGTGGATTGGCATTT
GGGATTTTTGATCTCATATATACTTATTGCACCATGGTGGGTTTGATGGTTTATGCCTTTTCAGCCATTTTGAGTTTA
TGCCTAACCTTTTTAAGCTTAAGGTTTCAACACAACTTTTTGAGGGTGACAAGTTCGTAGGCTCTTTTGAAAATGCTGCA
GCAGGTACATTTGTGCTTGATATGCATGCCTATGAGAGACTTGCCAACTCTATCTCAACTGAAAAACTGCGTCAGTATGC
TAGTACTTACAATAAGTACAAGTATTATTCAGGCAGTGCTTCAGAGGCTGATTACAGGCTTGCTTGTTTTGCCCATTTGG
CCAAGGCTATGATGGATTATGCTTCTAATCACAACGACACGTTATACACACCACCCACTGTGAGTTACAATTCAACTCTA
CAGGCTGGCTTGCGTAAGATGGCACAACCATCTGGTGTTGTTGAGAAGTGCATAGTTCGTGTTTGCTATGGTAATATGGC
TCTTAATGGCCTATGGCTTGGTGATACTGTTATCTGCCCACGCCATGTTATAGCGTCTAGTACTACTAGCACTATAGATT
ATGACTATGCCCTTTCTGTTTTACGCCTCCACAACTTCTCCATTTCATCTGGTAATGTTTTCCTAGGTGTTGTGGGTGTA
ACCATGCGAGGTGCTTTGTTGCAGATAAAGGTTAATCAAAACAATGTCCACACGCCTAAGTACACCTATCGCACAGTTAG
ACCGGGTGAATCTTTTAATATCTTGGCGTGCTATGATGGTTCTGCAGCTGGTGTTTACGGCGTTAACATGCGCTCTAATT
ACACTATTAGAGGCTCGTTCATTAATGGCGCTTGTGGTTCACCTGGTTATAACATTAACAATGGTACCGTTGAGTTTTGC
TATTTACACCAGCTTGAACTTGGTTCAGGCTGTCATGTTGGTAGCGACTTAGATGGTGTTATGTATGGTGGTTATGAGGA
CCAACCTACTTTGCAAGTTGAAGGCGCTAGTAGTCTGTTTACAGAGAATGTGTTGGCATTTCTTTATGCAGCACTCATTA
ATGGTTCTACCTGGTGGCTTAGTTCTTCTAGGATTGCTGTAGACAGGTTTAATGAGTGGGCTGTTCATAATGGTATGACA
```

Fig. 23B2

```
ACAGTAGTTAATACTGATTGCTTTTCTATTCTTGCTGCTAAGACTGGTGTTGATGTACAACGTTTGTTGGCCTCAATCCA
GTCTCTGCATAAGAATTTTGGTGGAAAGCAAATTCTTGGCTATACCTCGTTGACAGATGAGTTTACTACAGGTGAAGTTA
TACGTCAAATGTATGGCGTTAATCTTCAGAGTGGTTATGTTTCACGCGCCTGTAGAAATGTCTTGCTGGTTGGTTCTTTT
CTGACTTTCTTTTGGTCAGAATTAGTTTCCTACACTAAGTTCTTTTGGGTAAATCCTGGTTATGTCACACCTATGTTTGC
GTGTTTGTCATTGCTGTCCTCACTTTTGATGTTCACACTCAAGCATAAGACATTGTTTTTCCAGGTCTTTCTAATACCTG
CTCTGATTGTTACATCTTGCATTAATTTGATGTTGAAGTCTACACTATTTGGCAGAGCATTTTGATTACCAT
GTTTCTCTCATGGGTTTTAATGCACAAGGTCTTGTTAACATCTTTGTCTGCTTTGTTGTTACCATTTTACACGGCACATA
CACATGGCGCTTTTTTAACACACCTGTGAGTTCTGTCACTTATGTGGTAGCTTTGCTGACTGCGGCATATAACTATTTTT
ACGCTAGTGACATTCTTAGTTGTGCTATGACACTATTTGCTAGTGTGACTGGCAACTGGTTCGTTGGTGCTGTTTGTTAT
AAAGCTGCTGTTTATATGGCCTTGAGATTTCCTACTTTTGTGGCTATTTTTGGTGATATTAAGAGTGTTATGTTCTGTTA
CCTTGTGTTGGGTTATTTTACCTGTTGCTTCTACGGTATTCTCTACTGGTTCAACAGGTTTTTTAAGGTTAGTGTAGGTG
TCTATGACTATACTGTTAGTGCTGCTGAGTTTAAGTATATGGTTGCTAACGGCCTACGTGCACCAACTGGAACACTTGAT
TCACTACTTCTGTCTGCCAAATTGATTGGTATTGGTGGTGAGCGGAATATTAAGATTCTTCCGTTCAGTCTAAACTGAC
TGATATTAAGTGTAGTAACGTTGTGCTTTTAGGCTGTCTCTCTAGCATGAATGTTTCAGCAAATTCAACAGAATGGGCCT
ATTGTGTTGACTTGCATAACAAGATCAACTTGTGTAATGACCCAGAAAAGCGCAGGAAATGCTACTTGCTTTGTTGGCA
TTTTTCCTTAGTAAGAATAGTGCTTTTGGTTTAGATGACTTATTGGAATCCTATTTAATGACAATAGTATGTTGCAGAG
TGTTGCATCTACTTATGTCGGTTTGCCTTCTTATGTCATTTATGAAAATGCACGCCAACAGTATGAAGATGCTGTTAATA
ATGGTTCTCCACCTCAGTTGGTTAAGCAATTGCGCCATGCCATGAATGTAGCAAAGAGCGAATTTGACCGTGAGGCTTCT
ACTCAGCGTAAGCTTGATAGAATGGCGGAACAGGCTGCAGCACAGATGTACAAAGAGGCACGAGCAGTTAATAGGAAGTC
CAAAGTTGTAAGTGCTATGCATTCACTGCTTTTTGGTATGTTGAGACGTTTGGACATGTCTTCTGTAGACACCATTCTCA
ACTTGGCAAAGGATGGGGTTGTACCTCTGTCTGTCATACCGGCAGTCAGTGCTACTAAGCTTAACATTGTTACTTCTGAT
ATCGATTCTTATAATCGTATCCAGCGTGAGGGATGTGTCCACTACGCTGGTACCATTTGGAATATAATTGATATCAAGGA
CAATGATGGCAAGGTGGTACACGTTAAGGAGGTAACCGCACAGAATGCTGAGTCCCTGTCATGGCCCCTGGTCCTTGGGT
GTGAGCGTATTGTCAAGCTCCAGAATAATGAAATTATTCCTGGTAAGCTGAAGCAGCGCTCCATTAAGGCAGAAGGAGAT
GGCATAGTTGGAGAAGGTAAGGCACTTTACAATAATGAGGGTGGACGTACTTTTATGTATGCTTTCATCTCGGACAAACC
GGACCTGCGTGTAGTCAAGTGGGAGTTCGATGGTGGTTGTAACACTATTGAGCTAGAACCACCACGTAAGTTCTTGGTGG
ATTCTCCTAATGGTGCACAGATCAAGTATCTCTACTTTGTTCGTAACCTTAACACGTTACGTAGGGGTGCTGTTCTCGGC
TACATAGGTGCCACTGTACGCTTGCAGGCTGGTAAACAAACAGAACAGGCTATTAACTCTTCATTGTTGACACTTTGCGC
TTTCGCTGTGGATCCTGCTAAGACCTACATCGATGCTGTCAAAAGTGGTCACAAACCAGTAGGTAACTGTGTTAAGATGT
TGGCCAATGGTTCTGGTAATGGACAAGCTGTTACTAATGGTGTGGAGGCTAGTACTAACCAGGATTCATATGGTGGTGCG
TCCGTGTGTCTATATTGTAGAGCACATGTTGAGCATCCATCTATGGATGGTTTTTGCAGACTGAAAGGCAAGTACGTACA
GGTTCCACTAGGTACAGTGGATCCTATACGTTTTGTACTTGAGAATGACGTTTGCAAGGTTTGTGGTTGTTGGCTGGCTA
ATGGCTGCACTTGTGACAGATCCATTATGCAAAGCACTGATATGGCTTATTTAAACGAGTACGGGGCTCTAGTGCAGCTC
GACTAGAGCCCTGTAACGGTACTGATACACAACATGTGTATCGTGCTTTTGACATCTACAACAAGGATGTTGCTTGTCTA
GGTAAATTCCTCAAGGTGAACTGTGTTCGCCTGAAGAATTTGGATAAGCATGATGCATTCTATGTTGTCAAAAGATGTAC
CAAGTCTGCGATGGAACACGAGCAATCCATCTATAGCAGACTTGAAAAGTGTGGAGCCGTAGCCGAACACGATTTCTTCA
CTTGGAAGGATGGTCGTGCAATCTATGGTAACGTTTGTAGAAAGGATCTTACCGAGTATACTATGATGGATTTGTGTTAC
GCTTTACGTAACTTTGATGAAAACAATTGCGATGTTCTTAAGAGCATTTTAATTAAGGTAGGCGCTTGTGAGGAGTCCTA
CTTCAATAATAAAGTCTGGTTTGACCCTGTTGAAAATGAAGACATTCATCGTGTTTATGCATTGTTAGGTACCATTGTTT
CACGTGCTATGCTTAAATGCGTTAAGTTCTGTGATGCAATGGTTGAACAAGGTATAGTTGGTGTTGTCACATTAGATAAT
CAGGATCTTAATGGTGATTTTATGATTTTGGTGATTTTACTTGTAGCATCAAGGGAATGGGTATACCCATTTGCACATC
ATATTACTCTTATATGATGCCTGTTATGGGTATGACTAATTGCCTTGCTAGTGAGTGTTTTGTTAAGAGTGATATATTTG
GTGAGGATTTCAAGTCATATGACCTGCTGGAATATGATTTCACGGAGCATAAGACAGCACTCTTCAACAAGTATTTCAAG
TATTGGGACTGCAATACCACCCTAACTGTGTGGACTGCAGTGATGAGCAGTGCATAGTTCACTGTGCCAATTTCAATAC
GTTGTTTTCCACTACTATACCTATTACGGCATTTGGACCTTTGTGTCGCAAGTGTTGGATTGATGGTGTTCCACTGGTAA
CTACAGCTGGTTATCATTTAAACAGTTAGGTATAGTTTGGAACAATGACCTCAACTTACACTCTAGCAGGCTCTCTATT
AACGAACTACTCCAGTTTTGTAGTGATCCTGCATTGCTCTATAGCATCATCACCAGCCCTTGTTGATCAGCGTACTGTTTG
CTTTTCAGTTGCAGCGCTAGGTACAGGTACGATGCTAACCAGACGTTAAACCTGGCCATTTCAATAAGGAGTTTTATGACT
TCTTACTTGAGCAAGGTTTCTTTTCTGAGGGCTCTGAGCTTACTTTAAAGCACTTCTTCTTTGCACAGAAGGGTGATGCA
GCTGTTAAGGATTTTGACTACTATAGGTATAATAGACCTACTGTTCTGGACATTTGCCAAGCTCGCGTCGTGTATCAAAT
AGTGCAACGCTATTTTGATATTTACGAAGGTGGTTGTATCACTGCTAAAGAAGTGGTTGTTACAAACCTTAACAAGAGCG
CAGGTTATCCTTTGAACAAGTTTGGTAAAGCTGGTCTTTACTATGAGTCTTTATCCTATGAGGAACAGGATGAACTTTAT
GCTTATACTAAGCGTAACATCCTGCCCACTATGACACAGCTCAACCTTAAATATGCTATAAGTGGCAAAGAACGTGCACG
CACAGTGGGTGGTGTTTCGCTTTTGTCAACCATGACTACTCGGCAGTATCACCAGAAACACCTTAAGTCCATAGTTAATA
CTAGGGGCGCTTCGGTTGTTATTGGTACTACTAAGTTTTATGGTGGTTGGGACAATATGCTTAAGAACCTTATTGATGGT
GTCGAAAATCCGTGTCTTATGGGTTGGGATTACCCAAAGTGCGACAGAGCACTGCCCAATATGATACGCATGATTTCAGC
CATGATTTAGGCTCTAAGCACACCACATGCTGCAGTTCCACTGACCGCTTTTTCAGGTTGTGCAATGAATTGGCTCAAG
TCCTTACTGAGGTTGTTTATTCTAATGGAGGTTTTTATTGAAGCCAGGTGGTACTACCTCTGGTGATGCAACCACCGCA
TATGCAAACTCAGTTTTCAATATCTTCCAAGCAGTAAGTGCCAATGTTAATAAACTTCTTAGTGTTGACAGCAATGTCTG
TCATAATTTAGAAGTTAAGCAATTGCAGCGTAAGCTTATGAGTGCTGTTATAGATCAACTACCGTTGATGACCAGTTCG
TCGTTGAGTATTATGGTTACTTGCGTAAACATTTTTCAATGATGATTCTTTCTGATGATGGCGTTGTTTGTTACAACAAT
GACTATGCATCACTTGGTTATGTCGCTGATCTTAACGCATTCAAGGCTGTTTTGTATTACCAGAACAATGTCTTCATGAG
CGCCTCTAAATGTTGGATCGAGCCTGACATTAATAAAGGTCCTCATGAATTTTGCTCGCAGCATACTATGCAGATTGTCG
```

Fig. 23B3

```
ATAAAGATGGTACTTACTACCTACCTTACCCTGATCCTTCAAGAATCCTCTCTGCAGGTGTGTTTGTTGACGACGTTGTT
AAAACTGATGCAGTTGTATTGCTTGAACGTTATGTGTCATTGGCTATAGATGCCTACCCGTTATCTAAGCATGAAAACCC
TGAATATAAGAAGGTGTTTTATGTGCTTTTGGATTGGGTTAAGCACCTGTATAAACTTTGAATGCTGGTGTGTTAGAGT
CTTTTTCTGTCACACTTTTGGAAGATTCTACTGCTAAATTCTGGGATGAGAGCTTTTATGCCAACATGTATGAGAAATCT
GCAGTTTTGCAATCTGCAGGGCTTTGTGTTGTTTGTGGCTCTCAAACTGTTTTACGTTGTGGTGATTGTCTACGGCGTCC
TATGCTTTGTACTAAGTGTGCTTATGATCATGTCATTGGAACAACTCACAAGTTCATTTTGGCCATCACTCCATATGTGT
GTTGTGCTTCAGATTGTGGTGTCAATGATGTAACTAAGCTCTATTTAGGTGGTCTTAGTTATTGGTGTCATGACCACAAG
CCACGTCTTGCATTCCCGTTGTGCTCTGCTGGTAATGTTTTTGGCTTGTACAAAAATTCTGCTACCGGCTCACCCGATGT
TGAAGACTTTAATCGCATTGCTACATCCGATTGGACTGATGTTTCTGACTACAGGTTGGCAAATGATGTCAAGGACTCAT
TGCGTCTGTTTGCAGCGGAAACTATCAAGGCCAAGGAGGAGAGCGTTAAGTCATCCTATGCTTGTGCAACACTACATGAG
GTTGTAGGACCTAAAGAGTTGTTGCTCAAATGGGAAGTCGGCAGACCCAAACCACCCCTTAATAGAAATTCGGTTTTCAC
TTGTTATCATATAACGAAGAACACCAAATTTCAAATCGGTGAGTTTGTGTTTGAGAAGGCAGAATATGATAATGATGCTG
TAACATATAAAACTACCGCCACAACAAAACTTGTTCCTGGCATGGTTTTTGTGCTTACCTCACATAATGTTCAGCCATTG
CGCGCACCGACCATTGCTAACCAAGAACGTTATTCCACTATACATAAGTTGCATCCTGCTTTTAACATACCTGAAGCTTA
TTCTAGCTTAGTGCCCTATTACCAATTGATTGGTAAGCAGAAGATTACAACTATTCAGGGACCTCCCGGTAGTGGTAAAT
CTCACTGTGTTATAGGGCTAGGTTTGTACTATCCAGGTGCACGTATAGTGTTTACAGCTTGTTCTCATGCAGCGGTCGAT
TCACTTTGTGTGAAAGCTTCCACTGCTTATAGCAATGACAAATGTTCACGCATCATACCACAGCGCGCTCGTGTTGAGTG
TTATGATGGTTTCAAGTCTAATAATACTAGTGCTCAGTACCTTTTCTCTACTGTCAATGCTTTGCCAGAGTGCAATGCGG
ACATTGTGTGGTGGATGAGGTCTCTATGTGCACTAATTATGACTTGTCTGTCATAAATCAGCGCATCAGCTATAGGCAT
GTAGTCTATGTTGGTGACCCTCAACAGCTGCCTGCACCACGTGTTATGATTTCACGTGGTACTTTGGAACCAAAGGACTA
CAACGTTGTCACTCAACGCATGTGTGCCCTTAAGCCTGATGTTTTCTTGCACAAGTGTTATCGCTGTCCTGCTGAGATAG
TGCGTACTGTGTCTGAGATGGTCTATGAAAACCAATTCATTCCTGTGCACCCAGATAGCAAGCAGTGTTTTAAAATCTTT
TGCAAGGGTAATGTTCAGGTTGATAATGGTTCAAGCATTAATCGCAGGCAATTGGATGTTGTGCGTATGTTTTGGCTAA
AAATCCTAGGTGGTCAAAGGCTGTTTTTATTTCTCCTTATAACAGCCAGAATTATGTTGCCAGCCGCATGCTAGGTCTAC
AAATTCAGACAGTTGACTCATCCCAGGGTAGTGAGTATGACTATGTCATTTACACACAAACTTCAGATACTGCCCATGCC
TGTAATGTAACAGGTTTAATGTTGCCATCACAAGGGCCAAGAAAGGCATATTATGTATAATGTGCGATAGGTCCCTTTT
TGATGTGCTTAAATTCTTTGAGCTTAAATTGTCTGATTTGCAGGCTAATGAGGGTTGTGGTCTTTTTAAAGACTGTAGCA
GAGGTGATGATCTGTTGCCACCATCTCACGCTAACACCTTCATGTCTTTAGCGGACAATTTTAAGACTGATCAAGATCTT
GCTGTTCAAATAGGTGTTAATGGACCCATTAAATATGAGCATGTTATCTCGTTTATGGGTTTCCGTTTTGATATCAACAT
ACCCAACCATCATACTCTCTTTTGCACACGCGACTTTGCCATGCGCAATGTTAGAGGTTGGTTAGGCTTTGACGTTGAAG
GAGCACATGTTGTTGGCTCTAACGTCGGTACAAATGTCCCATTGCAATTAGGGTTTTCTAACGGTGTTGATTTTGTTGTC
AGACCTGAAGGTTGCGTTGTAACAGAGTCTGGTGACTCACATTAAACCCGTCAGAGCTCGTGCTCCACCAGGGGAACAATT
CGCACACCTTTTGCCTTTACTTAAACGCGGCCAACCATGGGATGTTGTCCGCAAACGTATAGTGCAGATGTGTAGTGACT
ACCTGGCCAACCTATCAGACATACTAATTTTTGTGTTGTGGGCTGGTGGTTTGGAGTTGACAACTATGCGTTATTTTGTC
AAGATTGGACCAAGTAAGAGTTGTGATTGTGGTAAGGTTGCTACTTGTTACAATAGTGCGCTGCATACGTACTGTTGTTT
CAAACATGCCCTTGGTTGTGATTATCTGTATAACCCATACTGTATTGATATACAGCAGTGGGGATACAAGGGATCACTTA
GCCTTAACCACCATGAGCATTGTAATGTACATAGAAACGAGCATGTGGCTTCGGTGATGCCATAATGACTCGCTGTCTG
GCCATACATGATTGCTTTGTCAAGAACGTTGACTGGTCCATCACATACCCATTTATTGGTAATGAGGCTGTTATTAATAA
GAGCGGCCGAATTGTGCAATCACACACTATGCGGTCAGTTCTTAAGTTATACAATCCGAAAGCCATATATGATATTGGCA
ATCCTAAGGGCATTAGATGTGCCGTAACGGATGCTAAGTGGTTTTGCTTTGACAAGAATCCTACTAATTCTAATGTCAAG
ACATTGGAGTATGACTATATAACACATGGCCAATTTGATGGGTTGTGCTTGTTTTGGAATTGCAATGTAGACATGTATCC
AGAATTTTCTGTGGTCTGTCGTTTTGATACTCGCTGTAGGTCACCACTCAACTTGGAGGGTTGTAATGGTGGTTCACTGT
ATGTTAATAATCATGCATTCCATACACCGGCTTTTGACAAGCGTGCTTTTGCTAAGTTGAAGCCAATGCCATTTTCTTT
TATGATGATACTGAGTGTGACAAGTTACAGGACTCCATAAACTATGTTCCTCTTAGGGCTAGTAACTGCATTACTAAATG
TAATGTTGGTGGTGCTGTCTGTAGTAAGCATTGTGCTATGTATCATAGCTATGTTAATGCTTACAACACTTTTACGTCGG
CGGGCTTTACTATTTGGGTGCCTACTTCGTTTGACACCTATAATCTGTGGCAGACATTTAGTAACAATTTGCAAGGTCTT
GAGAACATTGCTTTCAATGTCGTAAAGAAAGGATCTTTTGTTGGTCCGGACCCAAGGTGAACTTCCTGTAGCTGTGGTTAATGA
CAAAGTGCTCGTTAGATGGTACTGTTGATACTGTTGTTTTACAAGAAGTCACATCTACCCCACTAACGTAGCTTTTG
AGTTGTATGCCAAGCGTAAGGTAGGACTCACCCCACCCATTACGATCCTACGTAACTTGGGTGTAGTTTGTACATCTAAG
TGTGTCATTTGGGACTATGAAGCCGAACGTCCACTTACTACTTTACAAAGGATGTTTGTAAATATACCGACTTTGAGGG
TGACGTCTGTACACTCTTTGATAACAGCATTGTTGGTTCATTAGAGCGATTCTCCATGACCCAAAATGCTGTGCTTATGT
CACTTACAGCTGTTAAAAAGCTTACTGGCATAAAGTTAACTTATGGTTATCTTAATGGTGTCCCAGTTAACACACATGAA
GATAAACCTTTTACTTGGTATATTTACACTAGGAAGAACGGCAAGTTCGAGGACCATCCTGATGGCTATTTTACCCAAGG
TAGAACAACCGCTGATTTTAGCCCTCGTAGCGACATGGAAAAGGACTTCCTAAGTATGGATATGGGTCTGTTTATTAACA
AGTACGGACTTGAAGATTACGGCTTTGAGCACGTTGTGTATGGTGATGTTTCTAAAACCACCCTTGGTGGTTTACATCTA
CTAATTTCGCAGGTGCGTCTGGCCTGTATGGGTGTGCTTAAAATAGACGAGTTTGTGTCTAGTAATGATAGCACGTTAAA
GTCTTGTACTGTTACATATGCTGATAACCCTAGTAGTAAGATGGTTTGCACGTATATGGATCTCCTTCTTGACGATTTTG
TCAGCATTCTTAAATCGTTGGATTTGAGTGTTGTATCTAAAGTTCATGAAGTTATGGTCGATTGTAAAATGTGGAGGTGG
ATGTTGTGGTGTAAGGATCATAAACTCCAGACATTTTATCCGCAACTTCAGGCCAGTGAATGGAAATGTGGTTATTCCAT
GCCTTCTATTTACAAGATACAACGTATGTGTTTAGAACCTTGCAACCTCTATAACTATGGTGCTGGTATTAAGTTACCTG
ATGGCATTATGTTTAACGTAGTTAAATATACACAGCTTTGTCAATATCTTAATAGCACCACAATGTGTGTACCCCATCAC
ATGCGCGTGCTACATCTTGGTGCTGGCTCCGACAAGGGTGTTGCACCTGGCACGGCTGTCTTACGACGTTGGTTGCCACT
GGATGCCATTAGTTGACAATGATAGTGTGGATTACGTTAGCGATGCTGATTATAGTGTTACGGGAGATTGCTCTACCT
```

Fig. 23B4

```
TATACCTGTCAGATAAGTTTGACTTAGTTATATCTGATATGTATGATGGTAAGATTAAAAGTTGTGATGGGGAGAACGTG
TCTAAAGAAGGCTTCTTTCCCTATATTAATGGTGTCATCACTGAAAAGTTGGCACTTGGTGGTACTGTAGCTATTAAGGT
GACGGAGTTTAGTTGGAATAAGAAGTTGTATGAACTCATTCAGAAGTTTGAGTATTGGACAATGTTCTGTACCAGTGTTA
ACACGTCATCGTCAGAGGCATTTTTAATTGGTGTTCACTATTTAGGTGATTTTGCAAGTGGCGCTGTGATTGACGGCAAC
ACTATGCATGCCAATTATATCTTCTGGCGTAATTCCACAATTATGACTATGTCTTACAATAGTGTACTTGATTTAAGCAA
GTTCAATTGTAAGCATAAGGCTACAGTTGTTATTAATTTAAAAGATTCATCCATTAGTGATGTTGTGTTAGGTTTGTTGA
AGAATGGTAAGTTGCTAGTGCGTAATAATGACGCCATTTGTGGTTTTTCTAATCATTTGGTCAACGTAAACAAATGAAGT
CTTTAAATTACTTCTGGTTGTTCTTACCAGTACTTTCAACACTCAGCCTACCACAAGATGTCACTAGGTGCCAGTCCACT
ATTAACTTCAGGCGGTTCTTTTCAAAATTTAATGTGCAGGCACCTGCTGTCGTTTTGTTGGGTGGTTATCTACCTAGTAT
GAACTCCTCTAGCTGGTACTGTGGCACAGGTCTTGAAACTGCTAGTGGCGTGCATGGTATTTTCCTCAGTTACATCGATG
CTGGTCAGGGCTTTGAGATTGGCATTTCACAGGAGCCGTTTGATCCTAGTGGTTACCAGCTTTATTTACATAAGGCCACT
AATGGTAACCATAATGCTATTGCACGACTGCGCATTTGCCAGTTTCCAGATAATAAAACATTGGGCCCTACTGTTAATGA
TGTTACAACAGGTCGTAACTGCCTATTCAACAAAGCCATTCCAGCTTATATGCAGGATGGAAAAAATATCGTTGTCGGCA
TAACATGGGACAATGATCGTGTCACTGTTTTTGCTGACAAGATCTATCATTTTATCTTAAAAATGATTGGTCCCGTGTT
GCGACAAGATGTTACAATAAAAGAAGTTGTGCTATGCAATATGTTTATACACCTACCTACTACATGCTTAATGTTACTAG
TGCAGGTGAGGATGGCATTTATTATGAACCATGTACAGCTAATTGCAGTGGTTACGCTGCCAATGTGTTTGCCACTGATT
CTAATGGCCACATACCAGAAGGTTTTAGTTTTAATAATTGGTTTCTTTTGTCCAATGATTCCACTTTGTTGCATGGTAAG
GTGGTTTCCAACCAACCTTTGTTGGTCAATTGTCTTTTGGCCATTCCTAAGATTTATGGACTAGGCCAATTTTTCTCATT
CAATCAAACGATGGATGGCGTTTGTAATGGAGCTGCTGCGCAGCGTGCACCAGAGGCTCTGAGGTTTAATATTAATGACA
CCTCTGTCATTCTTGCTGAAGGCTCAATTGTACTTCATACTGCTTTAGGAACAAATCTTTCTTTTGTTTGCAGTAATTCT
TCAGATCCTCATCTAGCTACCTTCGCCATACCTCTGGGTGCTACCCAAGTACCTTATTATTGTTTTCTTAAAGTGGATAC
TTACAACTCCACTGTTTATAAATTTTTGGCTGTTTTACCTCCTACCGTCAGGGAAATTGTCATCACCAAGTATGGTGATG
TTTATGTCAATGGGTTTGGATACTTGCATCTCGGTTTGTTGGATGCTGTCACAATTAATTTCACTGGTCATGGCACTGAC
GATGATGTTTCTGGTTTTTGGACCATAGCATCGACTAATTTTGTTGATGCACTCATCGAAGTTCAAGGAACCGCCATTCA
GCGTATTCTTTATTGTGATGATCCTGTTAGCCAACTCAAGTGTTCTCAGGTTGCTTTTGACCTTGACGATGGTTTTTACC
CTATTTCTTCTAGAAACCTTCTGAGTCATGAACAGCCAATTTCTTTTGTTACTCTGCCATCATTTAATGATCATTCTTTT
GTTAACATTACTGTATCTGCTTCCTTTGGTGGTCATAGTGGTGCCAACCTTATTGCATCTGACACTACTATTAATGGGTT
TAGTTCTTTCTGTGTTGACACTAGACAATTTACCATTTCACTGTTTTATAACGTTACAAACAGTTATGGTTATGTGTCTA
AATCACAGGACAGTAATTGCCCTTTCACCTTGCAATCTGTTAATGATTACCTGTCTTTTAGCAAATTTGTGTTTCCACC
AGCCTTTTGGCTAGTGCCTGTACCATAGATCTTTTTGGTTACCCTGAGTTTGGTAGTGGTGTTAAGTTTACGTCCCTTTA
CTTTCAATTCACAAAGGGTGAGTTGATTACTGGCACGCCTAAACCACTTGAAGGTGTCACGGACGTTTCTTCTATGACTC
TGGATGTGTGTACCAAGTATACTATCTATGGCTTTAAAGGTGAGGGTATCATTACCCTTACAAATTCTAGCTTTTTGGCA
GGTGTTTATTACACATCTGATTCTGGACAGTTGTTAGCCTTTAAGAATGTCACTAGTGGTGCTGTTTATTCTGTTACGCC
ATGTTCTTTTTCAGAGCAGGCTGCATATGTTGATGATGATATAGTGGGTGTTATTTCTAGTTTGTCTAGCTCCACTTTTA
ACAGTACTAGGGAGTTGCCTGGTTTCTTCTACCATTCTAATGATGGCTCTAATTGTACAGAGCCTGTGTTGGTGTATAGT
AACATAGGTGTTTGTAAATCTGGCAGTATTGGCTACGTCCCATCTCAGTCTGGTCAAGTCAAGATTGCACCCACGGTTAC
TGGGAATATTAGTATTCCCACCAACTTTAGTATGAGTATTAGGACAGAATATTTACAGCTTTACAACACGCCTGTTAGTG
TTGATTGTGCCACATATGTTTGTAATGGTAACTCTCGTTGTAAACAATTACTCACCCAGTACACTGCAGCATGTAAGACC
ATAGAGTCAGCATTACAACTCAGCGCTAGGCTTGAGTCTGTTGAAGTTAACTCTATGCTTACTATTTCTGAAGAGGCTCT
ACAGTTAGCTACCATTAGTTCGTTTAATGGTGATGGATATAATTTTACTAATGTGCTGGGTGTTTCTGTGTATGATCCTG
CAAGTGGCAGGGTGGTACAAAAAAGGTCTTTTATTGAAGACCTGCTTTTTAATAAAGTGGTTACTAATGGCCTTGGTACT
GTTGATGAAGACTATAAGCGCGTTCTAATGGTCGCTCTGTGGCAGATCTAGTCTGTGCACAGTATTACTCTGGTGTCAT
GGTACTACCTGGTGTTGTTGACGCTGAGAAGCTTCACATGTATAGTGCGTCTCTCATCGGTGGTATGGTGCTAGGAGTT
TTACTTCTGCAGCGGCATTGCCTTTTAGCCATGCTGTTCAAGCTAGACTCAATTATCTTGCTCTACAGACGGATGTTCTA
CAGCGGAACCAGCAATTGCTTGCTGAGTCTTTTAACTCTGCTATTGGTAATATAACTCCAGCCTTTGAGAGTGTAAAGA
GGCTATTAGTCAAACTTCCAAGGGTTTGAACACTGTGGCTCATGCGCTTACTAAGGTTCAAGAGGTTGTTAACTCGCAGG
GTGCAGCTTTGACTCAACTTACCGTACAGCTGCAACAACTTCCAAGCCATTTCTAGTTCTATTGATGACAATTACTCT
CGACTGGACATTCTTTCAGCCGATGTTCAGGTTGACCGTCTCATCACCGGCAGATTATCGAGCACTTAATGCTTTTGTTGC
TCAAACCCTCACTAAGTATACTGAGGTTCAGGCTAGCAGGAAGTTAGCACAGCAAAAGGTTAATGAGTGCGTTAAATCGC
AATCTCAGCGTTATGGTTTTTGTGGTGGTGATGGCGAGCACATTTCTCTCTGGTACAGGCAGCACCTCAGGGCCTGCTG
TTTTTTACATACAGTACTTGTACCGAGTGATTTTGTAGATGTTATTGCCATCGCTGGCTTATGCGTTAACGATGAAATTGC
CTTGACTCTACGTGAGCCTGGCTTAGTCTTGTTTACGCATGAACTTCAAAATCATACTGCGACGGAATATTTTGTTTCAT
CGCGACGTATGTTTGAACCTAGAAAACCTACCGTTAGTGATTTTGTTCAAATTGAGAGTTGTGTGGTCACCTATGTCAAT
TTGACTAGAGACCAACTACCAGATGTAATCCCAGATTACATCGATGTTAACAAAACACTTGATGAGATTTTAGCTTCTCT
GCCCAATAGAACTGGTCCAAGTCTTCCTTTAGATGTTTTTAATGCCACTTATCTTAATCTCACTGGTGAAATTGCAGATT
TAGAGCAGCGTTCAGAGTCTCTCCGTAATACTACAGAGGAGCTTCAAAGTCTTATATATAATATCAACAACACACTAGTT
GACCTTGAGTGGCTCAACCGAGTTGAGACATATATCAAGTGGCCGTGGTGGGTTTGGTTGATTATTTCATTGTTCTCAT
CTTTGTTGTGTCATTACTAGTGTTCTGCTGCATTTCCACGGGTTGTTGTGGATGCTGCGGCTGCTGCTGTGCTTGTTTCT
CAGGTTGTTGTAGGGGTCCTAGACTTCAACCTTACGAAGTTTTTGAAAAGGTCCACGTGCAGTGATGTTTCTTGGACTTT
TTCAATACACGATTGACACAGTTGTCAAAGATGTCTCAAAGTCTGCTAACTTGTCTTTGGATGCTGTCCAAGAGTTGGAG
CTCAATGTAGTTCCAATTAGACAAGCTTCAAATGTGACGGGTTTTCTTTTCACCAGTGTTTTTATCTACTTCTTTGCACT
GTTTAAAGCGTCTTCTTTGAGGCGCAATTATATTATGTTGGCAGCGCGTTTTGCTGTCATTGTTCTTATTGCCCACTTT
TATATTATTGTGGTGCATTTTTAGATGCAACTATTATTTGTTGCACACTTATTGGCAGGCTTTGTTTAGTCTGCTTTTAC
```

```
TCCTGGCGCTATAAAAATGCGCTCTTTATTATTTTTAATACTACGACACTTTCTTTCCTCAATGGTAAAGCAGCTTTGAC
GGCAAATCCATTGTGATTTTAGAAGGTGGTGACCATTACATCACTTTTGGCAACTCCTTTGTTGCTTTTGTTAGTAGCAT
CGACTTGTATCTAGCTATACGTGGGCGGCAAGAAGCTGACCTACAGCTGTTGCGAACTGTTGAGCTTCTTGATGGCAAGA
AGCTTTATGTCTTTTCGCAACATCAAATTGTTGGCATTACTAATGCTGCATTTGACTCAATTCAACTAGACGAGTATGCT
ACAATTAGTGAATGATAATGGTCTAGTAGTTAATGTTATACTTTGGCTTTTCGTACTCTTTTTCCTGCTTATTATAAGCA
TTACTTTCGTCCAATTGGTTAATCTGTGCTTCACTTGTCACCGGTTGTGTAATAGCGCAGTTTACACACCTATAGGGCGT
TTGTATAGAGTTTATAAGTCTTACATGCAAATAGACCCCCTCCCTAGTACTGTTATTGACGTATAAACGAAATATGTCTA
ACGGTTCTATTCCCGTTGATGAGGTGATTCAACACCTTAGAAACTGGAATTTCACATGGAATATCATACTGACGATACTA
CTTGTAGTGCTTCAGTATGGCCATTACAAGTACTCTGCGTTCTTGTATGGTGTCAAGATGGCTATTCTATGGATACTTTG
GCCTCTTGTGTTAGCACTGTCACTTTTTGATGCATGGGCTAGCTTTCAGGTCAATTGGGTCTTTTTTGCTTTCAGCATCC
TTATGGCTTGCATCACTCTTATGCTGTGGATAATGTACTTTGTCAATAGCATTCGGTTGTGGCGCAGGACACATTCTTGG
TGGTCTTTCAATCCTGAAACAGACGCGCTTCTCACTACTTCTGTGATGGGCCGACAGGTCTGCATTCCAGTGCTTGGAGC
ACCAACTGGTGTAACGCTAACACTCCTTAGTGGTACATTGCTTGTAGAGGGCTATAAGGTTGCTACTGGCGTACAGGTAA
GTCAATTACCTAATTTCGTCACAGTCGCCAAGGCCACTACAACAATTGTCTACGGACGTGTTGGTCGTTCAGTCAATGCT
TCATCTGGCACTGGTTGGGCTTTCTATGTCCGGTCCAAACACGGCGACTACTCAGCTGTGAGTAATCCGAGTTCGGTTCT
CACAGATAGTGAGAAAGTGCTTCATTTAGTCTAAACAGAAACTTTATGGCTTCTGTCAGTTTTCAGGATCGTGGCCGCAA
ACGGGTGCCATTATCCCTCTATGCCCCTCTTAGGGTTACTAATCACAAACCCCTTTCTAAGGTACTTGCAAATAATGCTG
TACCCACTAATAAAGGAAATAAGGACCAGCAAATTGGATACTGGACTGAGCAAATTCGCTGGCGCATGCGCCGTGGTGAG
CGAATTGAACAACCTTCCAATTGGCATTTCTACTACCTCGGAACAGGACCTCACGCCGACCTCCGCTATAGGACTCGTAC
TGAGGGTGTTTTCTGGGTTGCTAAAGAAGGCGCAAAGACTGAACCCACTAACCTGGGTGTCAGAAAGGCGTCTGAAAAGC
CAATTATTCCAAATTTCTCTCAACAGCTTCCCAGCGTAGTTGAGATTGTTGAACCTAACACACCTCCTACTTCACGTGCA
AATTCACGTAGCAGGAGTCGTGGTAATGGCAACAACAGGTCCAGATCTCCAAGTAACAACAGAGGCAATAACCAGTCCCG
CGGTAATTCACAGAATCGTGGAAATAACCAGGGTCGTGGAGCTTCTCAGAACAGAGGAGGCAATAATAATAACAATAACA
AGTCTCGTAACCAGTCCAAGAACAGAAACCAGTCAAATGACCGTGGTGGTGTAACATCACGCGATGATCTGGTGGCTGCT
GTCAAGGATGCCCTTAAATCTTTGGGTATTGGCGAAAACCCTGACAAGCTTAAGCAACAGCAGAAGCCCAAACAGGAAAG
GTCTGACAGCAGCGGCAAAAATACACCTAAGAAGAACAAATCCAGAGCCACTTCGAAAGAACGTGACCTCAAAGACATCC
CAGAGTGGAGGAGAATTCCCAAGGGCGAAAATAGCGTAGCAGCTTGCTTCGGACCCAGGGGAGGCTTCAAAAATTTTGGA
GATGCGGAATTTGTCGAAAAAGGTGTTGATGCCTCAGGCTATGCTCAGATCGCCAGTTTAGCACCGAATGTTGCAGCATT
GCTCTTTGGTGGTAATGTGGCTGTTCGTGAGCTAGCGGACTCTTACGAGATTACATATAATTATAAAATGACTGTGCCAA
AGTCTGATCCAAATGTAGAGCTTCTTGTTTCACAGGTGGATGCATTTAAAACTGGGAATGCAAAACCCCAGAGAAAGAAG
GAAAAGAAGAACAAGCGTGAAACCACGCAGCAGCTGAATGAAGAGGCCATCTACGATGATGTGGGTGTGCCATCTGATGT
GACTCATGCCAATTTGGAATGGGACACAGCTGTTGATGGTGGTGACACGGCCGTTGAAATTATCAACGAGATCTTCGACA
CAGGAAATTAAACAATGTTTGACTGGCTTATCCTGGCTATGTCCCAGGGTAGTGCCATTACACTGTTATTACTGAGTGTT
TTTCTAGCGACTTGGCTGCTGGGCTATGGCTTTGCCCTCTAACTAGCGGTCTTGGTCTTGCACACAACGGTAAGCCAGTG
GTAATGTCAGTGCAAGAAGGATATTACCATAGCACTGTCATGAGGGGAACGCAGTACCTTTTCATCTAAACCTTTGCACG
AGTAATCAAAGATCCGCTTGACGAGCCTATATGGAAGAGCGTGCCAGGTATTTGACTCAAGGACTGTTAGTAACTGAAGA
CCTGACGGTGTTGATATGGATACAC
```

Fig. 23B6

Fig. 23C1 >USA/IL/2014/20697-P18R1 F6a complete genome (SEQ ID NO:37)
```
ACTTAAAAAGATTTTCTATCTACGGATAGTTAGCTCTTTTTCTAGACTCTTGTCTACTCAATTCAACTAAACGAAATTTT
GTCCTTCCGGCCGCATGTCCATGCTGCTGGAAGCTGACGTGGAATTTCATTAGGTTTGCTTAAGTAGCCATCGCAAGTGC
TGTGCTGTCCTCTAGTTCCTGGTTGGCGTTCCGTCGCCTTCTACATACTAGACAAACAGCCTTCCTCCGGTTCCGTCTGG
GGGTTGTGTGGATAACTAGTTCCGTCTAGTTTGAAACCAGTAACTGTCGGCTATGGCTAGCAACCATGTTACATTGGCTT
TTGCCAATGATGCAGAAATTTCAGCTTTTGGCTTTTGCACTGCTAGTGAAGCCGTCTCATACTATTCTGAGGCCGCCGCT
AGTGGATTTATGCAATGCCGTTTTGTGTCCTTCGATCTCGCTGACACTGTTGAGGGATTGCTTCCCGAAGACTATGTCAT
GGTGGTGGTCGGCACTACCAAGCTTAGTGCGTATGTGGACACTTTTGGTAGCCGCCCCAAAAACATTTGTGGTTGGCTGT
TATTTTCTAACTGTAATTACTTCCTCGAAGAGTTAGAGCTTACTTTTGGTCGTCGTGGTGGTAACATCGTGCCAGTTGAC
CAATACATGTGTGGCGCTGACGGTAAACCTGTTCTTCAGGAATCCGAATGGGAGTATACAGATTTCTTTGCTGACTCCGA
AGACGGTCAACTCAACATTGCTGGTATCACTTATGTGAAGGCCTGGATTGTAGAGCGATCGGATGTCTCTTATGCGAGTC
AGAATTTAACATCTATTAAGTCTATTACTTACTGTTCAACCTATGAGCATACTTTTCCTGATGGTACTGCCATGAAGGTT
GCACGTACTCCAAAGATTAAGAAGACTGTTGTCTTGTCTGAGCCACTTGCTACTATCTACAGGGAAATTGGTTCTCCTTT
TGTGGATAATGGGAGCGATGCTCGTTCTATCATTAAGAGACCAGTGTTCCTCCACGCTTTTGTTAAGTGTAAGTGTGGTA
GTTATCATTGGACTGTTGGTGATTGGACTTCCTATGTCTCCACTTGCTGTGGCTTTAAGTGTAAGCCAGTCCTTGTGGCT
TCATGCTCTGCTACGCCTGGTTCTGTTGTGGTTACGCGCGCTGGTGCTGGCACTGGTGTTAAGTATTACAACAACATGTT
CCTGCGCCATGTGGCAGACATTGATGGGTTGGCATTCTGGCGAATTCTCAAGGTGCAGTCCAAAGACGACCTCGCTTGCT
CTGGTAAATTCCTTGAACACCATGAGGAAGGTTTCACAGATCCTTGCTACTTTTGAATGACTCGAGCATTGCTACTAAG
CTCAAGTTTGACATCCTTAGTGGCAAGTTTTCTGATGAAGTCAAACAAGCTATCTTTGCTGGTCATGTTGTTGTTGGCAG
CGCGCTCGTTGACATTGTTGACGATGCACTGGGACAGCCTTGGTTTATACGTAAGCTTGGTGACCTTGCAAGTGCAGCTT
GGGAGCAGCTTAAGGCTGTCGTTAGAGGCCTTAACCTCCTGTCTGATGAGGTCGTGCTCTTTGGCAAAAGACTTAGCTGT
GCCACTCTTAGTATCGTTAACGGTGTTTTTGAGTTCATCGCCGAAGTGCCTGAGAAGTTGGCTGCGGCTGTTACAGTTTT
TGTCAACTTCTTGAATGAGCTTTTTGAGTCTGCCTGTGACTGCTTAAAGGTCGGAGGTAAAACCTTTAACAAGGTTGGCT
CTTATGTTCTTTTTGACAACGCATTGGTTAAGCTTGTCAAGGCAAAAGTTCGCGGCCCACGACAGGCAGGTGTTTGTGAA
GTTCGTTACACAAGCCTTGTTATTGGGAGTACTACCAAGGTGGTTTCCAAGCGCGTTGAAAATGCCAATGTGAATCTCGT
CGTCGTTGACGAGGATGCGACCCCCAACACCACTGGTCGTACAGTTGTTGTTGACGGACTTGCATTCTTCGAGAGTGACG
GGTTTTACAGACATCTTGCTGATGCTGACGTTGTCATTGAACATCCTGTTTATAAGTCTGCTTGTGAGCTCAAGCCAGTT
TTTGAGTGTGACCCAATACCTGATTTTCCTATGCCTGTGGCCGCTAGTGTTGCAGAGCTTTGTGTGCAAACTGATCTGTT
GCTTAAAAATTACAACACTCCTTATAAAACTTACAGCTGCGTTGTGAGAGGTGATAAGTGTTGTATCACTTGTACCTTAC
ATTTCACAGCACCAAGTTATATGGAGGCTGCTGCTAATTTTGTAGACCTCTGTACCAAGAACATTGGTACTGCTGGTTTT
CATGAGTTTTACATTACGGCCCATGAACAACAGGATCTGCAAGGGTTTGTAACCACTTGTTGCACGATGTCAGGTTTTGA
GTGTTTTATGCCTATAATCCCACAGTGTCCAGCAGTGCTTGAAGAGATTGATGGTGGTAGCATCTGGCGGTCTTTTATCA
CTGGTCTTAATACAATGTGGGATTTTTGCAAGCATCTTAAAGTCAGCTTTGGACTAGATGGCATTGTTGTCACTGTAGCA
CGCAAATTTAAACGACTTGGTGCTCTCTTGGCAGAAATGTATAACACTTACCTTTCAACTGTGGTGGAAAACTTGGTACT
GGCCGGTGTTAGCTTCAAGTATTATGCCACCAGTGTCCCAAAAATTGTTTTGGGCTGTTGTTTTCACAGTGTTAAAAGTG
TTCTTGCAAGTGCCTTCCAGATTCCTGTCCAGGCAGGCGTTGAGAAGTTTAAAGTCTTCCTTAACTGTGTTCACCCTGTT
GTACCACGTGTCATTGAAACTTCTTTTGTGGAATTAGAAGAGACGACATTTAAACCACCAGCACTCAATGGTAGTATTGC
TATTGTTGATGGCTTTGCTTTCTATTATGATGGAACACTATACTATCCCACCGATGGTAATAGCGTTGTTCCTATCTGCT
TTAAGAAGAAGGTGGTGGTGATGTCAAATTCTCTGATGAAGTCTCTGTTAAAACCATTGACCCAGTTTATAAGGTCTCC
CTTGAATTTGAGTTCGAGTCTGAGACTATTATGGCTGTGCTTAATAAGGCTGTTGGTAATTGTATCAAGGTTACAGGTGG
TTGGGACGATGTTGTTGAGTATATCAATGTTGCCATTGAGGTTCTTAAAGATCACATCGATGTGCCTAAGTACTACATCT
ATGATGAGGAAGGTGGCACCGATCCTAATCTGCCCGTAATGGTTTCTCAGTGGCCGTTGAATGATGACACGATCTCACAG
GATCTGCTTGATGTTGAAGTTGTTACTGATGCGCCAGTTGATTTCGAGGGTGATGAAGTAGACTCCTCTGACCCTGATAA
GGTGGCAGACGTGGCTAACTCTGAGCCTGAGGATGACGGTCTTAATGTAGCTCCTGAAACAAATGTAGAGTCTGAAGTTG
AGGAAGTTGCCGCAACCTTGTCCTTTATTAAAGATACACCTTCCACAGTTACTAAGGATCCTTTTGCTTTTGACTTTGCA
AGCTATGGAGGACTTAAGGTTTTAAGACAATCTCATAACAACTGCTGGGTTACTTCTACCTTGGTGCAGCTACAATGCT
TGGCATCGTTGATGACCCTGCAATGGAGCTTTTTAGTGCTGGTAGAGTTGGTCCAATGGTTCGCAAATGCTATGAGTCAC
AAAAGGCTATCTTGGGATCTTTGGGTGATGTGTCGGCTTGCTAGTGTCTGACTAAGGACCTACACACACACTTAAGATT
ACCTGTTCTGTAGTCTGTGGTTGTGGTACTGGTGAACGTATCTATGATGGTTGTGCTTTTCGTATGACGCCAACTTTGGA
ACCGTTCCCATATGGTGCTTGTGCTCAGTGTGCTCAAGTTTTGATGCACACTTTTAAAAGTATTGTTGGCACCGGCATCT
TTTGTCGAGATACTACTGCTCTCTCCTTGGATTCTTTGGTTGTAAAACCTCTTTGTGCGGCTGCTTTTATAGGCAAGGAT
AGTGGTCATTATGTCACTAACTTTATGATGCTGCTATGGCTATTGATGGTTATGGTCGTCATCAGATAAAGTATGACAC
ACTGAACACTATTTGTGTTAAAGACGTTAATTGGACAGCACCTTTTGTCCCAGACGTTGAGCCTGTATTGGAGCCTGTTG
TCAAACCTTTCTATTCTTATAAGAATGTTGATTTTTACCAAGGAGATTTTAGTGACCTTGTTAAACTTCCATGTGATTTT
GTTGTTAATGCTGCAAATGAGAATTTGTCTCACGGTGGCGGCATAGCAAAGGCCATTGATGTTTATACCAGGGGCATGTT
GCAGAAGTGCTCGAATGATTACATTAAAGCACACGGTCCCATTAAAGTTGGACGTGGTGTCATGTTGGAGGCATTAGGTC
TTAAGGTCTTTAATGTTGTTGGTCCACGTAAGGGTAAGCATGCACCTGAGCTTCTTGTTAAGGCTTATAAGTCCGTTTTT
GCTAATTCAGGTGTTGCTCTTACACCTTTGATTAGTGTTGGAATTTTTAGTGTTCCTTTGGAAGAATCTTTATCTGCTTT
TCTTGCATGTGTTGGTGATCGCCACTGTAAGTGCTTTTGTTATAGTGACAAAGAGCGCGAGGCGATCATTAATTACATGG
ATGGCTTGGTAGATGCTATTTTCAAAGATGCACTTGTTGATACTACTCCTGTCCAGGAAGATGTTCAACAAGTTTCACAA
AAACCAGTTTTGCCTAATTTTGAACCTTTCAGGATTGAAGGTGCTCATGCTTTCTATGAGTGCAACCCTGAAGGTTTGAT
GTCATTAGGTGCTGACAAGCTGGTGTTGTTTACAAATTCCAATTTGGATTTTGTAGCGTTGGTAAGTGTCTTAACAATG
TGACTGGCGGTGCATTGCTTGAAGCCATAAATGTATTTAAAAAGAGTAACAAAACAGTGCCTGCTGGAACTGTGTTACT
```

```
TTTGAGTGTGCAGATATGATTTCTATTACTATGGTAGTATTGCCATCTGACGGTGATGCTAATTATGACAAAAATTATGC
ACGCGCCGTCGTCAAGGTATCTAAGCTTAAAGGCAAGTTATTGCTTGCTGTTGGTGATGCCATGTTGTATTCCAAGTTGT
CCCACCTCAGCGTGTTAGGTTTCGTATCCACACCTGATGATGTGGAGCGTTTCTACGCAAATAAGAGTGTGGTTATTAAA
GTTACTGAGGATACACGTAGTGTTAAGACTGTTAAAGTAGAATCCACTGTTACTTATGGACAACAAATTGGACCTTGTCT
TGTTAATGACACCGTTGTCACAGACAACAAACCTGTTGTTGCTGATGTTGTAGCTAAGGTTGTACCAAGTGCTAATTGGG
ATTCACATTATGGTTTTGATAAGGCTGGTGAGTTCCACATGCTAGACCATACTGGGTTTGCCTTTCCTAGTGAAGTTGTT
AACGGTAGGCGTGTGCTTAAAACCACAGATAATAACTGTTGGGTTAATGTTACATGTTTACAATTACAGTTTGCTAGATT
TAGGTTCAAGTCAGCAGGTCTACAGGCTATGTGGGAGTCCTATTGTACTGGTGATGTTGCTATGTTTGTGCATTGGTTGT
ACTGGCTTACTGGTGTTGACAAAGGTCAGCCTAGTGATTCAGAAAATGCACTTAACATGTTGTCTAAGTACATTGTTCCT
GCTGGTTCTGTCACTATTGAACGTGTCACGCATGACGGTTGTTGTTGTAGTAAGCGTGTTGTCACTGCACCAGTTGTGAA
TGCTAGCGTGTTGAAGCTTGGCGTCGAGGATGGTCTTTGTCCACATGGTCTTAACTACATTGACAAAGTTGTTGTAGTTA
AAGGTACTACAATTGTTGTCAATGTTGGAAAACCTGTAGTGGCACCATCGCACCTCTTTCTTAAGGGTGTTTCCTACACA
ACATTCCTAGATAATGGTAACGGTGTTGCCGGCCATTATACTGTTTTTGATCATGACACTGGTATGGTGCATGATGGAGA
TGTTTTTGTACCAGGTGATCTCAATGTGTCTCCTGTTACAAATGTTGTCGTCTCAGAGCAGACGGCTGTTGTGATTAAAG
ACCCTGTGAAGAAAGTAGAGTTAGACGCTACAAAGCTGTTAGACACTATGAATTATGCATCGGAAAGATTCTTTTCCTTT
GGTGATTTTATGTCACGTAATTTAATTACAGTGTTTTTGTACATCCTTAGTATTTTGGGTCTCTGTTTTAGGGCCTTTCG
TAAGAGGGATGTTAAAGTTCTAGCTGGTGTACCCCAACGTACTGGTATTATATTGCGTAAAAGTGTGCGCTATAATGCAA
AGGCTTTGGGTGTCTTCTTCAAGCTAAAACTTTATTGGTTCAAAGTTCTTGGTAAGTTTAGTTTGGGTATTTATGCATTG
TATGCATTACTATTCATGACAATACGCTTTACACCTATAGGTGGCCCTGTTTGTGATGATGTTGTTGCTGGTTATGCTAA
TTCTAGTTTTGACAAGAATGAGTATTGCAACAGTGTTATTTGTAAGGTCTGTCTCTATGGGTACCAGGAACTTTCGGACT
TCTCTCACACACAGGTAGTATGGCAACACCTTAGAGACCCATTAATTGGTAATGTGATGCCTTTCTTTATTTGGCATTT
CTGGCAATTTTTGGGGGTGTTTATGTAAAGGCTATTACTCTCTATTTTATTTTCCAGTACCTTAACATTCTTGGTGTGTT
TTTGGGCCTACAACAGTCCATTTGGTTTTTGCAGCTTGTGCCTTTTGATGTCTTTGGTGACGAGATCGTCGTCTTTTTCA
TCGTTACACGCGTATTGATGTTCCTTAAGCATGTTTTCCTTGGCTGCGATAAGGCATCTTGTGTGGCTTGCTCTAAGAGT
GCTCGCCTTAAGCGCGTTCCTGTCCAGACTATTTTTCAGGGTACTAGCAAATCCTTCTACGTACATGCCAATGGTGGTTC
TAAGTTCTGTAAGAAGCACAATTTCTTTTGTTTAAATTGTGATTCTTATGGTCCAGGCTGCACTTTTATTAATGACGTCA
TTGCAACTGAAGTTGGTAATGTTGTCAAACTTAATGTGCAACCGACAGGTCCTGCCACTATTCTTATTGACAAGGTTGAA
TTCAGTAATGGTTTTTACTATCTTTATAGTGGTGACACATTTTGGAAGTACAACTTTGACATAACAGATAACAAATACAC
TTGCAAAGAGTCACTTAAAAATTGTAGCATAATCACAGACTTTATTGTTTTTAACAATAATGGTTCCAATGTAAATCAGG
TTAAGAATGCATGTGTGTATTTTTCACAGATGCTTTGTAAACCTGTTAAGTTAGTGGACTCAGCGTTGTTGGCCAGTTTG
TCTGTTGATTTTGGTGCAAGCTTACATAGTGCTTTTGTTAGTGTGTTGTCGAATAGTTTTGGCAAAGACCTGTCAAGTTG
TAATGACATGCAGGATTGCAAGAGCACATTGGGTTTTGATGATGTACCATTGGATACCTTTAATGCTGCTGTTGCTGAGG
CTCATCGTTACGATGTCCTCTTGACTGACATGTCGTTCAACAATTTTACCACCAGTTATGCAAAACCAGAGGAAAAACTT
CCCGTCCATGACATTGCCACGTGTATGCGTGTAGGTGCCAAGATTGTTAATCATAACGTTCTTGTCAAGGATAGTATACC
TGTGGTGTGGCTTGTACGTGATTTCATTGCCCTTTCTGAAGAAACTAGGAAGTACATTATTCGTACGACTAAAGTTAAGG
GTATAACCTTCATGTTGACCTTTAATGATTGTCGTATGCATACTACCATACCTACTGTTTGCATTGCAAATAAGAAGGGT
GCAGGTCTTCCTAGTTTTCAAAGGTTAAGAAATTCTTCTGGTTTTTGTGTCTGTTCATAGTTGCTGTTTCTTTGCACT
AAGCTTTTTTGATTTTAGTACTCAGGTTAGCAGTGATAGTGATTATGACTTCAAGTATATTGAGAGTGGCCAGTTGAAGA
CTTTTGACAATCCACTTAGTTGTGTGCATAATGTCTTTAGTAACTTCGACCAGTGGCATGATGCCAAGTTTGGTTTCACC
CCCGTCAACAATCCTAGTTGTCCTATAGTCGTTGGTGTATCAGACGAAGCGCGCACTGTTCCAGGTATCCCAGCAGGTGT
TTATTTAGCTGGTAAAACACTTGTTTTTGCTATTAACACCATTTTTGGTACATCTGGTTTGTGCTTTGATGCTAGTGGCG
TTGCTGATAAGGGCGCTTGCATTTTAATTCGGCTTGCACCACATTATCTGGTTTGGGTGGAACTGCTGTCTACTGTTAT
AAGAATGGTCTAGTTGAAGGTGCTAAACTTTATAGTGAGTTGGCACCTCATAGCTACTATAAAATGGTAGATGGTAATAC
TGTGTCTTTACCTGAAATTATCTCACGCGGCTTTGGCATCCGTACTATCCGTACAAAGGCTATGACCTACTGTCGCGTTG
GCCAGTGTGTGCAATCTGCAGAAGGTGTTTGTTTTGGCGCCGATAGATTCTTTGTCTATAATGCAGAATCTGGTTCTGAC
TTTGTTTGTGCACAGGGCTCTTTACATTGTTGATGAACGTTATTAGTGTTTTTTCCAAGACAGTACCAGTAACTGTGTT
GTCTGGTCAAATACTTTTAATTGCATTATTGCTTTTGCTGCTGTTGCCGGTGTGTTCTTTTACAAAGTTAAGCGCA
TGTTCGGTGATATGCTGTTGGCGTTTCACCTGTCGGTGCTTGTACTTTGTTGAACAATGTTTCCTACATTGTAACACAG
AACACACTTGGCATGTTGGGCTATGCAACTTTGTACTTTTTGTGCACTAAAGGTGTTAGATATATGTGGATTGGCATTT
GGGATTTTTGATCTCATATATACTTATTGCACCATGGTGGGTTTTGATGGTTTATGCCTTTTCAGCCATTTTTGAGTTTA
TGCCTAACCTTTTTAAGCTTAAGGTTTCAACACAACTTTTTGAGGGTGACAAGTTCGTAGGCTCTTTTGAAAATGCTGCA
GCAGGTACATTTGTGCTTGATATGCATGCCTATGAGAGACTTGCCAACTCTATCTCAACTGAAAAACTGCGTCAGTATGC
TAGTACTTACAATAAGTACAAGTATTATTCAGGCAGTGCTTCAGAGGCTGATTACAGGCTTGCTTGTTTTGCCCATTTGG
CCAAGGCTATGATGGATTATGCTTCTAATCACAACGACACGTTATACACCACCCACTGTGAGTTACAATTCAACTCTA
CAGGCTGGCTTGCGTAAGATGGCACAACCATCTGGTGTTGTTGAGAAGTGCATAGTTCGTGTTTGCTATGGTAATATGGC
TCTTAATGGCCTATGCTTGGTGATACTGTTATCTGCCCACGCCATGTTATAGCGTCTAGTACTACTAGCACTATAGATT
ATGACTATGCCCTTCTGTTTTACGCCTCCACAACTTCTCCATTTCATCTGGTAATGTTTTCCTAGGTGTTGTGGGTGTA
ACCATGCGAGGTGCTTTGTTGCAGATAAAGGTTAATCAAAACAATGTCCACACGCCTAAGTACACCTATCGCACAGTTAG
ACCGGGTGAATCTTTTAATATCTTGGCGTGCTATGATGGTTCTGCAGCTGGTGTTTACGGCGTTAACATGCGCTCTAATT
ACACTATTAGAGGCTCGTTCATTAATGGCGCTTGTGGTTCACCTGGTTATAACATTAACAATGGTACCGTTGAGTTTTGC
TATTTACACCAGCTTGAACTTGGTTCAGGCTGTCATGTTGGTAGCGACTTAGATGGTGTTATGTATGGTGGTTATGAGGA
CCAACCTACTTTGCAAGTTGAAGGCGCTAGTAGTCTGTTTACAGAGAATGTGTTGGCATTTCTTTATGCAGCACTCATTA
ATGGTTCTACCTGGTGGCTTAGTTCTTCTAGGATTGCTGTAGACAGGTTTAATGAGTGGGCTGTTCATAATGGTATGACA
```

Fig. 23C2

```
ACAGTAGTTAATACTGATTGCTTTTCTATTCTTGCTGCTAAGACTGGTGTTGATGTACAACGTTTGTTGGCCTCAATCCA
GTCTCTGCATAAGAATTTTGGTGGAAAGCAAATTCTTGGCTATACCTCGTTGACAGATGAGTTTACTACAGGTGAAGTTA
TACGTCAAATGTATGGCGTTAATCTTCAGAGTGGTTATGTTTCACGCGCCTGTAGAAATGTCTTGCTGGTTGGTTCTTTT
CTGACTTTCTTTTGGTCAGAATTAGTTTCCTACACTAAGTTCTTTTGGGTAAATCCTGGTTATGTCACACCTATGTTTGC
GTGTTTGTCATTGCTGTCCTCACTTTTGATGTTCACACTCAAGCATAAGACATTGTTTTTCCAGGTCTTTCTAATACCTG
CTCTGATTGTTACATCTTGCATTAATTTGGCATTTGATGTTGAAGTCTACAACTATTTGGCAGAGCATTTTGATTACCAT
GTTTCTCTCATGGGTTTTAATGCACAAGGTCTTGTTAACATCTTTGTCTGCTTTGTTGTTACCATTTTACACGGCACATA
CACATGGCGCTTTTTTAACACACCTGTGAGTTCTGTCACTTATGTGGTAGCTTTGCTGACTGCGGCATATAACTATTTTT
ACGCTAGTGACATTCTTAGTTGTGCTATGACACTATTTGCTAGTGTGACTGGCAACTGGTTCGTTGGTGCTGTTTGTTAT
AAAGCTGCTGTTTATATGGCCTTGAGATTTCCTACTTTTGTGGCTATTTTTGGTGATATTAAGAGTGTTATGTTCTGTTA
CCTTGTGTTGGGTTATTTTACCTGTTGCTTCTACGGTATTCTCTACTGGTTCAACAGGTTTTTTAAGGTTAGTGTAGGTG
TCTATGACTATACTGTTAGTGCTGCTGAGTTTAAGTATATGGTTGCTAACGGCCTACGTGCACCAACTGGAACACTTGAT
TCACTACTTCTGTCTGCCAAATTGATTGGTATTGGTGGTGAGCGGAATATTAAGATTCTTCCGTTCAGTCTAAACTGAC
TGATATTAAGTGTAGTAACGTTGTGCTTTTAGGCTGTCTCTCTAGCATGAATGTTTCAGCAAATTCAACAGAATGGGCCT
ATTGTGTTGACTTGCATAACAAGATCAACTTGTGTAATGACCCAGAAAAGCGCAGGAAATGCTACTTGCTTTGTTGGCA
TTTTTCCTTAGTAAGAATAGTGCTTTTGGTTTAGATGACTTATTGGAATCCTATTTAATGACAATAGTATGTTGCAGAG
TGTTGCATCTACTTATGTCGGTTTGCCTTCTTATGTCATTTATGAAAATGCACGCCAACAGTATGAAGATGCTGTTAATA
ATGGTTCTCCACCTCAGTTGGTTAAGCAATTGCGCCATGCCATGAATGTAGCAAAGAGCGAATTTGACCGTGAGGCTTCT
ACTCAGCGTAAGCTTGATAGAATGGCGGAACAGGCTGCAGCACAGATGTACAAAGAGGCACGAGCAGTTAATAGGAAGTC
CAAAGTTGTAAGTGCTATGCATTCACTGCTTTTTGGTATGTTGAGACGTTTGGACATGTCTTCTGTAGACACCATTCTCA
ACTTGGCAAAGGATGGGGTTGTACCTCTGTCTGTCATACCGGCAGTCAGTGCTACTAAGCTTAACATTGTTACTTCTGAT
ATCGATTCTTATAATCGTATCCAGCGTGAGGGATGTGTCCACTACGCTGGTACCATTTGGAATATAATTGATATCAAGGA
CAATGATGGCAAGGTGGTACACGTTAAGGAGGTAACCGCACAGAATGCTGAGTCCCTGTCATGGCCCCTGGTCCTTGGGT
GTGAGCGTATTGTCAAGCTCCAGAATAATGAAATTATTCCTGGTAAGCTGAAGCAGCGCTCCATTAAGGCAGAAGGAGAT
GGCATAGTTGGAGAAGGTAAGGCACTTTACAATAATGAGGGTGGACGTACTTTTATGTATGCTTTCATCTCGGACAAACC
GGACCTGCGTGTAGTCAAGTGGGAGTTCGATGGTGGTTGTAACACTATTGAGCTAGAACCACCACGTAAGTTCTTGGTGG
ATTCTCCTAATGGTGCACAGATCAAGTATCTCTACTTTGTTCGTAACCTTAACACGTTACGTAGGGGTGCTGTTCTCGGC
TACATAGGTGCCACTGTACGCTTGCAGGCTGGTAAACAAACAGAACAGGCTATTAACTCTTCATTGTTGACACTTTGCGC
TTTCGCTGTGGATCCTGCTAAGACCTACATCGATGCTGTCAAAAGTGGTCACAAACCAGTAGGTAACTGTGTTAAGATGT
TGGCCAATGGTTCTGGTAATGGACAAGCTGTTACTAATGGTGTGGAGGCTAGTACTAACCAGGATTCATATGGTGGTGCG
TCCGTGTGTCTATATTGTAGAGCACATGTTGAGCATCCATCTATGGATGGTTTTTGCAGACTGAAAGGCAAGTACGTACA
GGTTCCACTAGGTACAGTGGATCCTATACGTTTTGTACTTGAGAATGACGTTTGCAAGGTTTGTGGTTGTTGGCTGGCTA
ATGGCTGCACTTGTGACAGATCCATTATGCAAAGCACTGATATGGCTTATTTAAACGAGTACGGGGCTCTAGTGCAGCTC
GACTAGAGCCCTGTAACGGTACTGATACACAACATGTGTATCGTGCTTTTGACATCTACAACAAGGATGTTGCTTGTCTA
GGTAAATTCCTCAAGGTGAACTGTGTTCGCCTGAAGAATTTGGATAAGCATGATGCATTCTATGTTGTCAAAAGATGTAC
CAAGTCTGCGATGGAACACGAGCAATCCATCTATAGCAGACTTGAAAAGTGTGGAGCCGTAGCCGAACACGATTTCTTCA
CTTGGAAGGATGGTCGTGCAATCTATGGTAACGTTTGTAGAAAGGATCTTACCGAGTATACTATGATGGATTTGTGTTAC
GCTTTACGTAACTTTGATGAAAACAATTGCGATGTTCTTAAGAGCATTTTAATTAAGGTAGGCGCTTGTGAGGAGTCCTA
CTTCAATAATAAAGTCTGGTTTGACCCTGTTGAAAATGAAGACATTCATCGTGTTTATGCATTGTTAGGTACCATTGTTT
CACGTGCTATGCTTAAATGCGTTAAGTTCTGTGATGCAATGGTTGAACAAGGTATAGTTGGTGTTGTCACATTAGATAAT
CAGGATCTTAATGGTGATTTTATGATTTTGGTGATTTTACTTGTAGCATCAAGGGAATGGGTATACCCATTTGCACATC
ATATTACTCTTATATGATGCCTGTTATGGGTATGACTAATTGCCTTGCTAGTGAGTGTTTTGTTAAGAGTGATATATTTG
GTGAGGATTTCAAGTCATATGACCTGCTGGAATATGATTTCACGGAGCATAAGACAGCACTCTTCAACAAGTATTTCAAG
TATTGGGACTGCAATACCACCCTAACTGTGTGGACTGCAGTGATGAGCAGTGCATAGTTCACTGTGCCAATTTCAATAC
GTTGTTTTCCACTACTATACCTATTACGGCATTTGGACCTTTGTCTCGAAGTGTTGGATTGATGGTGTTCCACTGGTAA
CTACAGCTGGTTATCATTTAAACAGTTAGGTATAGTTTGGAACAATGACCTCAACTTACACTCTAGCAGGCTCTCTATT
AACGAACTACTCCAGTTTTGTAGTGATCCTGCATTGCCTATAGCATCATCACCAGCCCTTGTTGATCAGCGTACTGTTTG
CTTTTCAGTTGACGCGCTAGGTACAGGTGATCTAACAACACGTCAAATCCTGGCCATTTCAATAAGGAGTTTTATGACT
TCTTACTTGAGCAAGGTTTCTTTTCTGAGGGCTCTGAGCTTACTTTAAAGCACTTCTTCTTTGCACAGAAGGGTGATGCA
GCTGTTAAGGATTTTGACTACTATAGGTATAATAGACCTACTGTTCTGGACATTTGCCAAGCTCGCGTCGTGTATCAAAT
AGTGCAACGCTATTTTGATATTTACGAAGGTGGTTGTATCACTGCTAAAGAAGTGGTTGTTACAAACCTTAACAAGAGCG
CAGGTTATCCTTTGAACAAGTTTGGTAAAGCTGGTCTTTACTATGAGTCTTTATCCTATGAGGAACAGGATGAACTTTAT
GCTTATACTAAGCGTAACATCCTGCCCACTATGACACAGCTCAACCTTAAATATGCTATAAGTGGCAAAGAACGTGCACG
CACAGTGGGTGGTGTTTCGCTTTTGTCAACCATGACTACTCGGCAGTATCACCAGAAACACCTTAAGTCCATAGTTAATA
CTAGGGGCGCTTCGGTTGTTATTGGTACTACTAAGTTTTATGGTGGTTGGGACAATATGCTTAAGAACCTTATTGATGGT
GTCGAAAATCCGTGTCTTATGGGTTGGGATTACCCAAAGTGCGACAGAGCACTGCCCAATATGATACGCATGATTTCAGC
CATGATTTAGGCTCTAAGCACACCACATGCTGCAGTTCCACTGACCGCTTTTTCAGGTTGTGCAATGAATTGGCTCAAG
TCCTTACTGAGGTTGTTTATTCTAATGGAGGTTTTTATTTGAAGCCAGGTGGTACTACCTCTGGTGATGCAACCACCGCA
TATGCAAACTCAGTTTTCAATATCTTCCAAGCAGTAAGTGCCAATGTTAATAAACTTCTTAGTGTTGACAGCAATGTCTG
TCATAATTTAGAAGTTAAGCAATTGCAGCGTAAGCTTTATGAGTGCTGTTATAGATCAACTACCGTTGATGACCAGTTCG
TCGTTGAGTATTATGGTTACTTGCGTAAACATTTTCAATGATGATTCTTTCTGATGATGGCGTTGTTTGTTACAACAAT
GACTATGCATCACTTGGTTATGTCGCTGATCTTAACGCATTCAAGGCTGTTTTGTATTACCAGAACAATGTCTTCATGAG
CGCCTCTAAATGTTGGATCGAGCCTGACATTAATAAAGGTCCTCATGAATTTTGCTCGCAGCATACTATGCAGATTGTCG
```

Fig. 23C3

```
ATAAAGATGGTACTTACTACCTACCTTACCCTGATCCTTCAAGAATCCTCTCTGCAGGTGTGTTTGTTGACGACGTTGTT
AAAACTGATGCAGTTGTATTGCTTGAACGTTATGTGTCATTGGCTATAGATGCCTACCCGTTATCTAAGCATGAAAACCC
TGAATATAAGAAGGTGTTTTATGTGCTTTTGGATTGGGTTAAGCACCTGTATAAACTTTGAATGCTGGTGTGTTAGAGT
CTTTTTCTGTCACACTTTTGGAAGATTCTACTGCTAAATTCTGGGATGAGAGCTTTTATGCCAACATGTATGAGAAATCT
GCAGTTTTGCAATCTGCAGGGCTTTGTGTTGTTTGTGGCTCTCAAACTGTTTTACGTTGTGGTGATTGTCTACGGCGTCC
TATGCTTTGTACTAAGTGTGCTTATGATCATGTCATTGGAACAACTCACAGTTCATTTTGGCCATCACTCCATATGTGT
GTTGTGCTTCAGATTGTGGTGTCAATGATGTAACTAAGCTCTATTTAGGTGGTCTTAGTTATTGGTGTCATGACCACAAG
CCACGTCTTGCATTCCCGTTGTGCTCTGCTGGTAATGTTTTTGGCTTGTACAAAAATTCTGCTACCGGCTCACCCGATGT
TGAAGACTTTAATCGCATTGCTACATCCGATTGGACTGATGTTTCTGACTACAGGTTGGCAAATGATGTCAAGGACTCAT
TGCGTCTGTTTGCAGCGGAAACTATCAAGGCCAAGGAGGAGAGCGTTAAGTCATCCTATGCTTGTGCAACACTACATGAG
GTTGTAGGACCTAAAGAGTTGTTGCTCAAATGGGAAGTCGGCAGACCCAAACCACCCCTTAATAGAAATTCGGTTTTCAC
TTGTTATCATATAACGAAGAACACCAAATTTCAAATCGGTGAGTTTGTGTTTGAGAAGGCAGAATATGATAATGATGCTG
TAACATATAAAACTACCGCCACAACAAAACTTGTTCCTGGCATGGTTTTTGTGCTTACCTCACATAATGTTCAGCCATTG
CGCGCACCGACCATTGCTAACCAAGAACGTTATTCCACTATACATAAGTTGCATCCTGCTTTTAACATACCTGAAGCTTA
TTCTAGCTTAGTGCCCTATTACCAATTGATTGGTAAGCAGAAGATTACAACTATTCAGGGACCTCCCGGTAGTGGTAAAT
CTCACTGTGTTATAGGGCTAGGTTTGTACTATCCAGGTGCACGTATAGTGTTTACAGCTTGTTCTCATGCAGCGGTCGAT
TCACTTTGTGTGAAAGCTTCCACTGCTTATAGCAATGACAAATGTTCACGCATCATACCACAGCGCGCTCGTGTTGAGTG
TTATGATGGTTTCAAGTCTAATAATACTAGTGCTCAGTACCTTTTCTCTACTGTCAATGCTTTGCCAGAGTGCAATGCGG
ACATTGTGTGGTGGATGAGGTCTCTATGTGCACTAATTATGACTTGTCTGTCATAAATCAGCGCATCAGCTATAGGCAT
GTAGTCTATGTTGGTGACCCTCAACAGCTGCCTGCACCACGTGTTATGATTTCACGTGGTACTTTGGAACCAAAGGACTA
CAACGTTGTCACTCAACGCATGTGTGCCCTTAAGCCTGATGTTTTCTTGCACAAGTGTTATCGCTGTCCTGCTGAGATAG
TGCGTACTGTGTCTGAGATGGTCTATGAAAACCAATTCATTCCTGTGCACCCAGATAGCAAGCAGTGTTTTAAAATCTTT
TGCAAGGGTAATGTTCAGGTTGATAATGGTTCAAGCATTAATCGCAGGCAATTGGATGTTGTGCGTATGTTTTGGCTAA
AAATCCTAGGTGGTCAAAGGCTGTTTTTATTTCTCCTTATAACAGCCAGAATTATGTTGCCAGCCGCATGCTAGGTCTAC
AAATTCAGACAGTTGACTCATCCCAGGGTAGTGAGTATGACTATGTCATTTACACACAAACTTCAGATACTGCCCATGCC
TGTAATGTAACAGGTTTAATGTTGCCATCACAAGGGCCAAGAAAGGCATATTATGTATAATGTGCGATAGGTCCCTTTT
TGATGTGCTTAAATTCTTTGAGCTTAAATTGTCTGATTTGCAGGCTAATGAGGGTTGTGGTCTTTTTAAAGACTGTAGCA
GAGGTGATGATCTGTTGCCACCATCTCACGCTAACACCTTCATGTCTTTAGCGGACAATTTTAAGACTGATCAAGATCTT
GCTGTTCAAATAGGTGTTAATGGACCCATTAAATATGAGCATGTTATCTCGTTTATGGGTTTCCGTTTTGATATCAACAT
ACCCAACCATCATACTCTCTTTTGCACACGCGACTTTGCCATGCGCAATGTTAGAGGTTGGTTAGGCTTTGACGTTGAAG
GAGCACATGTTGTTGGCTCTAACGTCGGTACAAATGTCCCATTGCAATTAGGGTTTTCTAACGGTGTTGATTTTGTTGTC
AGACCTGAAGGTTGCGTTGTAACAGAGTCTGGTGACTCACATTAAACCCGTCAGAGCTCGTGCTCCACCAGGGGAACAATT
CGCACACCTTTTGCCTTTACTTAAACGCGGCCAACCATGGGATGTTGTCCGCAAACGTATAGTGCAGATGTGTAGTGACT
ACCTGGCCAACCTATCAGACATACTAATTTTTGTGTTGTGGGCTGGTGGTTTGGAGTTGACAACTATGCGTTATTTTGTC
AAGATTGGACCAAGTAAGAGTTGTGATTGTGGTAAGGTTGCTACTTGTTACAATAGTGCGCTGCATACGTACTGTTGTTT
CAAACATGCCCTTGGTTGTGATTATCTGTATAACCCATACTGTATTGATATACAGCAGTGGGGATACAAGGGATCACTTA
GCCTTAACCACCATGAGCATTGTAATGTACATAGAAACGAGCATGTGGCTTCGGTGATGCCATAATGACTCGCTGTCTG
GCCATACATGATTGCTTTGTCAAGAACGTTGACTGGTCCATCACATACCCATTTATTGGTAATGAGGCTGTTATTAATAA
GAGCGGCCGAATTGTGCAATCACACACTATGCGGTCAGTTCTTAAGTTATACAATCCGAAAGCCATATATGATATTGGCA
ATCCTAAGGGCATTAGATGTGCCGTAACGGATGCTAAGTGGTTTTGCTTTGACAAGAATCCTACTAATTCTAATGTCAAG
ACATTGGAGTATGACTATATAACACATGGCCAATTTGATGGGTTGTGCTTGTTTTGGAATTGCAATGTAGACATGTATCC
AGAATTTTCTGTGGTCTGTCGTTTTGATACTCGCTGTAGGTCACCACTCAACTTGGAGGGTTGTAATGGTGGTTCACTGT
ATGTTAATAATCATGCATTCCATACACCGGCTTTTGACAAGCGTGCTTTTGCTAAGTTGAAGCCAATGCCATTTTCTTT
TATGATGATACTGAGTGTGACAAGTTACAGGACTCCATAAACTATGTTCCTCTTAGGGCTAGTAACTGCATTACTAAATG
TAATGTTGGTGGTGCTGTCTGTAGTAAGCATTGTGCTATGTATCATAGCTATGTTAATGCTTACAACACTTTTACGTCGG
CGGGCTTTACTATTTGGGTGCCTACTTCGTTTGACACCTATAATCTGTGGCAGACATTTAGTAACAATTTGCAAGGTCTT
GAGACATTGCTTTCAATGTCGTAAAGAAAGGATCTTTTGTTGGTCCGAAAGGTGAACTTCCTGTAGCTGTGGTTAATGA
CAAAGTGCTCGTTAGACATGCGTACTGTTGATACTGTTGTTTTACAACAAGCATCACTACCCACTAACGTAGCTTTTG
AGTTGTATGCCAAGCGTAAGGTAGGACTCACCCCACCCATTACGATCCTACGTAACTTGGGTGTAGTTTGTACATCTAAG
TGTGTCATTTGGGACTATGAAGCCGAACGTCCACTTACTACTTTACAAAGGATGTTTGTAAATATACCGACTTTGAGGG
TGACGTCTGTACACTCTTTGATAACAGCATTGTTGGTTCATTAGAGCGATTCTCCATGACCCAAAATGCTGTGCTTATGT
CACTTACAGCTGTTAAAAAGCTTACTGGCATAAAGTTAACTTATGGTTATCTTAATGGTGTCCCAGTTAACACACATGAA
GATAAACCTTTTACTTGGTATATTTACACTAGGAAGAACGGCAAGTTCGAGGACCATCCTGATGGCTATTTTACCCAAGG
TAGAACAACCGCTGATTTTAGCCCTCGTAGCGACATGGAAAAGGACTTCCTAAGTATGGATATGGGTCTGTTTATTAACA
AGTACGGACTTGAAGATTACGGCTTTGAGCACGTTGTGTATGGTGATGTTTCTAAAACCACCCTTGGTGGTTTACATCTA
CTAATTTCGCAGGTGCGTCTGGCCTGTATGGGTGTGCTTAAAATAGACGAGTTTGTGTCTAGTAATGATAGCACGTTAAA
GTCTTGTACTGTTACATATGCTGATAACCCTAGTAGTAAGATGGTTTGCACGTATATGGATCTCCTTCTTGACGATTTTG
TCAGCATTCTTAAATCGTTGGATTTGAGTGTTGTATCTAAAGTTCATGAAGTTATGGTCGATTGTAAAATGTGGAGGTGG
ATGTTGTGGTGTAAGGATCATAAACTCCAGACATTTTATCCGCAACTTCAGGCCAGTGAATGGAAATGTGGTTATTCCAT
GCCTTCTATTTACAAGATACAACGTATGTGTTTAGAACCTTGCAACCTCTATAACTATGGTGCTGGTATTAAGTTACCTG
ATGGCATTATGTTTAACGTAGTTAAATATACACAGCTTTGTCAATATCTTAATAGCACCACAATGTGTGTACCCCATCAC
ATGCGCGTGCTACATCTTGGTGCTGGCTCCGACAAGGGTGTTGCACCTGGCACGGCTGTCTTACGACGTTGGTTGCCACT
GGATGCCATTATAGTTGACAATGATAGTGTGGATTACGTTAGCGATGCTGATTATAGTGTTACGGGAGATTGCTCTACCT
```

Fig. 23C4

```
TATACCTGTCAGATAAGTTTGACTTAGTTATATCTGATATGTATGATGGTAAGATTAAAAGTTGTGATGGGGAGAACGTG
TCTAAAGAAGGCTTCTTTCCCTATATTAATGGTGTCATCACTGAAAAGTTGGCACTTGGTGGTACTGTAGCTATTAAGGT
GACGGAGTTTAGTTGGAATAAGAAGTTGTATGAACTCATTCAGAAGTTTGAGTATTGGACAATGTTCTGTACCAGTGTTA
ACACGTCATCGTCAGAGGCATTTTTAATTGGTGTTCACTATTTAGGTGATTTTGCAAGTGGCGCTGTGATTGACGGCAAC
ACTATGCATGCCAATTATATCTTCTGGCGTAATTCCACAATTATGACTATGTCTTACAATAGTGTACTTGATTTAAGCAA
GTTCAATTGTAAGCATAAGGCTACAGTTGTTATTAATTTAAAAGATTCATCCATTAGTGATGTTGTGTTAGGTTTGTTGA
AGAATGGTAAGTTGCTAGTGCGTAATAATGACGCCATTTGTGGTTTTTCTAATCATTTGGTCAACGTAAACAAATGAAGT
CTTTAAATTACTTCTGGTTGTTCTTACCAGTACTTTCAACACTCAGCCTACCACAAGATGTCACTAGGTGCCAGTCCACT
ATTAACTTCAGGCGGTTCTTTTCAAAATTTAATGTGCAGGCACCTGCTGTCGTTTTGTTGGGTGGTTATCTACCTAGTAT
GAACTCCTCTAGCTGGTACTGTGGCACAGGTCTTGAAACTGCTAGTGGCGTGCATGGTATTTTCCTCAGTTACATCGATG
CTGGTCAGGGCTTTGAGATTGGCATTTCACAGGAGCCGTTTGATCCTAGTGGTTACCAGCTTTATTTACATAAGGCCACT
AATGGTAACCATAATGCTATTGCACGACTGCGCATTTGCCAGTTTCCAGATAATAAAACATTGGGCCCTACTGTTAATGA
TGTTACAACAGGTCGTAACTGCCTATTCAACAAAGCCATTCCAGCTTATATGCAGGATGGAAAAAATATCGTTGTCGGCA
TAACATGGGACAATGATCGTGTCACTGTTTTTGCTGACAAGATCTATCATTTTTATCTTAAAAATGATTGGTCCCGTGTT
GCGACAAGATGTTACAATAAAAGAAGTTGTGCTATGCAATATGTTTATACACCTACCTACTACATGCTTAATGTTACTAG
TGCAGGTGAGGATGGCATTTATTATGAACCATGTACAGCTAATTGCAGTGGTTACGCTGCCAATGTGTTTGCCACTGATT
CTAATGGCCACATACCAGAAGGTTTTAGTTTTAATAATTGGTTTCTTTTGTCCAATGATTCCACTTTGTTGCATGGTAAG
GTGGTTTCCAACCAACCTTTGTTGGTCAATTGTCTTTTGGCCATTCCTAAGATTTATGGACTAGGCCAATTTTTCTCATT
CAATCAAACGATGGATGGCGTTTGTAATGGAGCTGCTGCGCAGCGTGCACCAGAGGCTCTGAGGTTTAATATTAATGACA
CCTCTGTCATTCTTGCTGAAGGCTCAATTGTACTTCATACTGCTTTAGGAACAAATCTTTCTTTTGTTTGCAGTAATTCT
TCAGATCCTCATCTAGCTACCTTCGCCATACCTCTGGGTGCTACCCAAGTACCTTATTATTGTTTTCTTAAAGTGGATAC
TTACAACTCCACTGTTTATAAATTTTTGGCTGTTTTACCTCCTACCGTCAGGGAAATTGTCATCACCAAGTATGGTGATG
TTTATGTCAATGGGTTTGGATACTTGCATCTCGGTTTGTTGGATGCTGTCACAATTAATTTCACTGGTCATGGCACTGAC
GATGATGTTTCTGGTTTTTGGACCATAGCATCGACTAATTTTGTTGATGCACTCATCGAAGTTCAAGGAACCGCCATTCA
GCGTATTCTTTATTGTGATGATCCTGTTAGCCAACTCAAGTGTTCTCAGGTTGCTTTTGACCTTGACGATGGTTTTTACC
CTATTTCTTCTAGAAACCTTCTGAGTCATGAACAGCCAATTTCTTTTGTTACTCTGCCATCATTTAATGATCATTCTTTT
GTTAACATTACTGTATCTGCTTCCTTTGGTGGTCATAGTGGTGCCAACCTTATTGCATCTGACACTACTATTAATGGGTT
TAGTTCTTTCTGTGTTGACACTAGACAATTTACCATTTCACTGTTTATAACGTTACAAACAGTTATGGTTATGTGTCTA
AATCACAGGACAGTAATTGCCCTTTCACCTTGCAATCTGTTAATGATTACCTGTCTTTTAGCAAATTTTGTGTTTCCACC
AGCCTTTTGGCTAGTGCCTGTACCATAGATCTTTTTGGTTACCCTGAGTTTGGTAGTGGTGTTAAGTTTACGTCCCTTTA
CTTTCAATTCACAAAGGGTGAGTTGATTACTGGCACGCCTAAACCACTTGAAGGTGTCACGGACGTTTCTTCTATGACTC
TGGATGTGTGTACCAAGTATACTATCTATGGCTTTAAAGGTGAGGGTATCATTACCCTTACAAATTCTAGCTTTTTGGCA
GGTGTTTATTACACATCTGATTCTGGACAGTTGTTAGCCTTTAAGAATGTCACTAGTGGTGCTGTTTATTCTGTTACGCC
ATGTTCTTTTTCAGAGCAGGCTGCATATGTTGATGATGATATAGTGGGTGTTATTTCTAGTTTGTCTAGCTCCACTTTTA
ACAGTACTAGGGAGTTGCCTGGTTTCTTCTACCATTCTAATGATGGCTCTAATTGTACAGAGCCTGTGTTGGTGTATAGT
AACATAGGTGTTTGTAAATCTGGCAGTATTGGCTACGTCCCATCTCAGTCTGGTCAAGTCAAGATTGCACCCACGGTTAC
TGGGAATATTAGTATTCCCACCAACTTTAGTATGAGTATTAGGACAGAATATTTACAGCTTTACAACACGCCTGTTAGTG
TTGATTGTGCCACATATGTTTGTAATGGTAACTCTCGTTGTAAACAATTACTCACCCAGTACACTGCAGCATGTAAGACC
ATAGAGTCAGCATTACAACTCAGCGCTAGGCTTGAGTCTGTTGAAGTTAACTCTATGCTTACTATTTCTGAAGAGGCTCT
ACAGTTAGCTACCATTAGTTCGTTTAATGGTGATGGATATAATTTTACTAATGTGCTGGGTGTTTCTGTGTATGATCCTG
CAAGTGGCAGGGTGGTACAAAAAAGGTCTTTTATTGAAGACCTGCTTTTTAATAAAGTGGTTACTAATGGCCTTGGTACT
GTTGATGAAGACTATAAGCGCGTTCTAATGGTCGCTCTGTGGCAGATCTAGTCTGTGCACAGTATTACTCTGGTGTCAT
GGTACTACCTGGTGTTGTTGACGCTGAGAAGCTTCACATGTATAGTGCGTCTCTCATCGGTGGTATGGTGCTAGGAGGTT
TTACTTCTGCAGCGGCATTGCCTTTTAGCCATGCTGTTCAAGCTAGACTCAATTATCTTGCTCTACAGACGGATGTTCTA
CAGCGGAACCAGCAATTGCTTGCTGAGTCTTTTAACTCTGCTATTGGTAATATAACTCCAGCCTTTGAGAGTGTTAAAGA
GGCTATTAGTCAAACTTCCAAGGGTTTGAACACTGTGGCTCATGCGCTTACTAAGGTTCAAGAGGTTGTTAACTCGCAGG
GTGCAGCTTTGACTCAACTTACCGTACAGCTGCAACAAAACTTCCAAGCCATTTCTAGTTCATTATTGATGACAATTACTC
CGACTGACATTCTTTCAGCCGATGTTCAGGTTGACCGTCTCATCACCGGCAGATTATCATCACCACTTAATGCTTTTGTTGC
TCAAAACCCTCACTAAGTATACTGAGGTTCAGGCTAGCAGGAAGTTAGCACACAAAAGGTTAATGAGTGCGTTAAATCGC
AATCTCAGCGTTATGGTTTTTGTGGTGGTGATGGCGAGCACATTTCTCTCTGGTACAGGCAGCACCTCAGGGCCTGCTG
TTTTTACATACAGTACTTGTACCGAGTGATTTTGTAGATGTTATTGCCATCGCTGGCTTATGCGTTAACGATGAAATTGC
CTTGACTCTACGTGAGCCTGGCTTAGTCTTGTTTACGCATGAACTTCAAAATCATACTGCGACGGAATATTTTGTTTCAT
CGCGACGTATGTTTGAACCTAGAAAACCTACCGTTAGTGATTTTGTTCAAATTGAGAGTTGTGTGGTCACCTATGTCAAT
TTGACTAGAGACCAACTACCAGATGTAATCCCAGATTACATCGATGTTAACAAAACACTTGATGAGATTTTAGCTTCTCT
GCCCAATAGAACTGGTCCAAGTCTTCCTTTAGATGTTTTTAATGCCACTTATCTTAATCTCACTGGTGAAATTGCAGATT
TAGAGCAGCGTTCAGAGTCTCTCCGTAATACTACAGAGGAGCTTCAAAGTCTTATATATAATATCAACAACACACTAGTT
GACCTTGAGTGGCTCAACCGAGTTGAGACATATATCAAGTGGCCGTGGTGGGTTTGGTTGATTATTTCATTGTTCTCAT
CTTTGTTGTGTCATTACTAGTGTTCTGCTGCATTTCCACGGGTTGTTGTGGATGCTGCGGCTGCTGCTGTGCTTGTTTCT
CAGGTTGTTGTAGGGGTCCTAGACTTCAACCTTACGAAGTTTTTGAAAAGGTCCACGTGCAGTGATGTTCTTGGACTTT
TTCAATACACGATTGACACAGTTGTCAAAGATGTCTCAAAGTCTGCTAACTTGTCTTTGGATGCTGTCCAAGAGTTGGAG
CTCAATGTAGTTCCAATTAGACAAGCTTCAAATGTGACGGGTTTTCTTTTCACCAGTGTTTTTATCTACTTCTTTGCACT
GTTTAAAGCGTCTTCTTTGAGGCGCAATTATATTATGTTGGCAGCGCGTTTTGCTGTCATTGTTCTTTATTGCCCACTTT
TATATTATTGTGGTGCATTTTTAGATGCAACTATTATTTGTTGCACACTTATTGGCAGGCTTTGTTTAGTCTGCTTTTAC
```

Fig. 23C5

```
TCCTGGCGCTATAAAAATGCGCTCTTTATTATTTTTAATACTACGACACTTTCTTTCCTCAATGGTAAAGCAGCTTTGAC
GGCAAATCCATTGTGATTTTAGAAGGTGGTGACCATTACATCACTTTTGGCAACTCCTTTGTTGCTTTTGTTAGTAGCAT
CGACTTGTATCTAGCTATACGTGGGCGGCAAGAAGCTGACCTACAGCTGTTGCGAACTGTTGAGCTTCTTGATGGCAAGA
AGCTTTATGTCTTTTCGCAACATCAAATTGTTGGCATTACTAATGCTGCATTTGACTCAATTCAACTAGACGAGTATGCT
ACAATTAGTGAATGATAATGGTCTAGTAGTTAATGTTATACTTTGGCTTTTCGTACTCTTTTTCCTGCTTATTATAAGCA
TTACTTTCGTCCAATTGGTTAATCTGTGCTTCACTTGTCACCGGTTGTGTAATAGCGCAGTTTACACACCTATAGGGCGT
TTGTATAGAGTTTATAAGTCTTACATGCAAATAGACCCCCTCCCTAGTACTGTTATTGACGTATAAACGAAATATGTCTA
ACGGTTCTATTCCCGTTGATGAGGTGATTCAACACCTTAGAAACTGGAATTTCACATGGAATATCATACTGACGATACTA
CTTGTAGTGCTTCAGTATGGCCATTACAAGTACTCTGCGTTCTTGTATGGTGTCAAGATGGCTATTCTATGGATACTTTG
GCCTCTTGTGTTAGCACTGTCACTTTTTGATGCATGGGCTAGCTTTCAGGTCAATTGGGTCTTTTTTGCTTTCAGCATCC
TTATGGCTTGCATCACTCTTATGCTGTGGATAATGTACTTTGTCAATAGCATTCGGTTGTGGCGCAGGACACATTCTTGG
TGGTCTTTCAATCCTGAAACAGACGCGCTTCTCACTACTTCTGTGATGGGCCGACAGGTCTGCATTCCAGTGCTTGGAGC
ACCAACTGGTGTAACGCTAACACTCCTTAGTGGTACATTGCTTGTAGAGGGCTATAAGGTTGCTACTGGCGTACAGGTAA
GTCAATTACCTAATTTCGTCACAGTCGCCAAGGCCACTACAACAATTGTCTACGGACGTGTTGGTCGTTCAGTCAATGCT
TCATCTGGCACTGGTTGGGCTTTCTATGTCCGGTCCAAACACGGCGACTACTCAGCTGTGAGTAATCCGAGTTCGGTTCT
CACAGATAGTGAGAAAGTGCTTCATTTAGTCTAAACAGAAACTTTATGGCTTCTGTCAGTTTTCAGGATCGTGGCCGCAA
ACGGGTGCCATTATCCCTCTATGCCCCTCTTAGGGTTACTAATCACAAACCCCTTCTAAGGTACTTGCAAATAATGCTG
TACCCACTAATAAAGGAAATAAGGACCAGCAAATTGGATACTGGACTGAGCAAATTCGCTGGCGCATGCGCCGTGGTGAG
CGAATTGAACAACCTTCCAATTGGCATTTCTACTACCTCGGAACAGGACCTCACGCCGACCTCCGCTATAGGACTCGTAC
TGAGGGTGTTTTCTGGGTTGCTAAAGAAGGCGCAAAGACTGAACCCACTAACCTGGGTGTCAGAAAGGCGTCTGAAAAGC
CAATTATTCCAAATTTCTCTCAACAGCTTCCCAGCGTAGTTGAGATTGTTGAACCTAACACACCTCCTACTTCACGTGCA
AATTCACGTAGCAGGAGTCGTGGTAATGGCAACAACAGGTCCAGATCTCCAAGTAACAACAGAGGCAATAACCAGTCCCG
CGGTAATTCACAGAATCGTGGAAATAACCAGGGTCGTGGAGCTTCTCAGAACAGAGGAGGCAATAATAATAACAATAACA
AGTCTCGTAACCAGTCCAAGAACAGAAACCAGTCAAATGACCGTGGTGGTGTAACATCACGCGATGATCTGGTGGCTGCT
GTCAAGGATGCCCTTAAATCTTTGGGTATTGGCGAAAACCCTGACAAGCTTAAGCAACAGCAGAAGCCCAAACAGGAAAG
GTCTGACAGCAGCGCAAAAATACACCTAAGAAGAACAAATCCAGAGCCACTTCGAAAGAACGTGACCTCAAAGACATCC
CAGAGTGGAGGAGAATTCCCAAGGGCGAAAATAGCGTAGCAGCTTGCTTCGGACCCAGGGGAGGCTTCAAAAATTTTGGA
GATGCGGAATTTGTCGAAAAAGGTGTTGATGCCTCAGGCTATGCTCAGATCGCCAGTTTAGCACCGAATGTTGCAGCATT
GCTCTTTGGTGGTAATGTGGCTGTTCGTGAGCTAGCGGACTCTTACGAGATTACATATAATTATAAAATGACTGTGCCAA
AGTCTGATCCAAATGTAGAGCTTCTTGTTTCACAGGTGGATGCATTTAAAACTGGGAATGCAAAACCCCAGAGAAAGAAG
GAAAAGAAGAACAAGCGTGAAACCACGCAGCAGCTGAATGAAGAGGCCATCTACGATGATGTGGGTGTGCCATCTGATGT
GACTCATGCCAATTTGGAATGGGACACAGCTGTTGATGGTGGTGACACGGCCGTTGAAATTATCAACGAGATCTTCGACA
CAGGAAATTAAACAATGTTTGACTGGCTTATCCTGGCTATGTCCCAGGGTAGTGCCATTACACTGTTATTACTGAGTGTT
TTTCTAGCGACTTGGCTGCTGGGCTATGGCTTTGCCCTCTAACTAGCGGTCTTGGTCTTGCACACAACGGTAAGCCAGTG
GTAATGTCAGTGCAAGAAGGATATTACCATAGCACTGTCATGAGGGGAACGCAGTACCTTTTCATCTAAACCTTTGCACG
AGTAATCAAAGATCCGCTTGACGAGCCTATATGGAAGAGCGTGCCAGGTATTTGACTCAAGGACTGTTAGTAACTGAAGA
CCTGACGGTGTTGATATGGATACAC
```

Fig. 23C6

Fig. 24A INDEL Sequence comparison

Summary:
- Compared to the P5 virus: P7R1, P8R1, P18R1 and P19R1 viruses had 4-nucleotide deletion (ATTA) at the nucleotide positions 25,197-25,200, resulting in early stop of ORF3 translation of the P7R1, P8R1 and P18R1 viruses. The deduced P7R1, P8R1, P18R1 and P19R1 ORF3 proteins are 143 aa long.
- The P19R1 F6a clone varies in 2 amino acids from all other virus passage sequences (except the other clone), L to P change in ORF1a/1b at position 551 and Y to H change in Spike at position 973.
- The P18R1 G8b clone varies in 1 amino acid from all other virus passage sequences (except the other clone), Y to H change in Spike at position 973.

Nucleotide changes

| | | Origin | DFigure 1 | | | | | | separate |
|---|---|---|---|---|---|---|---|---|---|
| | | Study | | | B2478 | B2533 | B2533 | B2533 | |
| | | Clone or Consensus | Consensus | Consensus | Consensus | Clone | Clone | Clone | Consensus |
| Genome region/ protein | Genome structure[a] | Position in Protein[b] | P5 | P7R1 | P8R1 | P18R1 89G8b | P18R1 94F6a | P18R1 92F6a | P45 |
| 5'UTR | 1-292 | | | | | | | | |
| ORF1a/1b | 293-12616 / 12616-20637 | 424 | C | T | T | T | T | T | C |
| | | 781 | T | G | G | G | G | G | T |
| | | 1944 | T | T | T | T | C | C | T |
| | | 2083 | T | T | T | T | T | T | C |
| | | 3610 | T | T | T | T | T | T | C |
| | | 5064 | A | A | A | A | A | A | T |
| | | 6367 | T | T | T | T | T | T | C |
| | | 7435 | A | A | A | A | A | A | G |
| | | 11080 | C | C | C | C | C | C | T |
| | | 12391 | C | C | C | T | T | T | C |
| | | 13387 | T | C | C | C | C | C | T |
| | | 13992 | T | G | G | G | G | G | T |
| | | 14691 | C | T | T | T | T | T | C |
| | | 15550-15551 | GT | GT | GT | GT | GT | GT | TC |
| | | 18704 | A | A | A | A | A | A | G |
| S/ Spike | | 20717 | C | C | C | C | C | C | T |

|   |   |   |   |   |   |   |   |   |
|---|---|---|---|---|---|---|---|---|
|   | 20775 | G | T | T | T | T | T | G |
|   | 21667 | C | T | T | T | T | T | C |
|   | 22232 | C | T | T | T | T | T | C |
|   | 22919 | C | C | C | C | C | C | T |
|   | 23283 | A | A | A | A | A | A | C |
|   | 23509 | T | T | T | T | T | A | C |
|   | 23550 | T | C | C | C | C | C | C |
|   | 23658 | T | T | T | T | T | C | T |
|   | 24307 | T | T | T | T | T | T | A |
| 20634-24785 | 24448 | T | C | C | C | C | C | T |
|   | 24808-24823 | CACGATTGA CACAGTT | CACGATTGA CACAGTT | CACGATTGA CACAGTT | CACGATTGA CACAGTT | CACGATTGA CACAGTT | CACGATTGA CACAGTT | --- |
|   | 25197-25200 | ATTA | --- | --- | --- | --- | --- | --A |
|   | 25285 | C | C | C | C | C | C | T |
|   | 25305-25360 | GTGGGCGGC AAGAAGCTG ACCTACAGCT GTTGCGAAC TGTTGAGCTT CTTGATGGC | GTGGGCGGC AAGAAGCTG ACCTACAGCT GTTGCGAAC TGTTGAGCTT CTTGATGGC | GTGGGCGGC AAGAAGCTG ACCTACAGCT GTTGCGAAC TGTTGAGCTT CTTGATGGC | GTGGGCGGC AAGAAGCTG ACCTACAGCT GTTGCGAAC TGTTGAGCTT CTTGATGGC | GTGGGCGGC AAGAAGCTG ACCTACAGCT GTTGCGAAC TGTTGAGCTT CTTGATGGC | GTGGGCGGC AAGAAGCTG ACCTACAGCT GTTGCGAAC TGTTGAGCTT CTTGATGGC | --- |
| ORF3 25440-25670 | 25624 | C | C | C | C | C | C | T |
| Envelope 25678-26358 | 26224 | G | G | G | G | G | G | A |
| Membrane 26370-27695 | 26448 | G | C | C | C | C | C | G |
| Nucleocapsid 26370-27695 | 26864 | T | C | C | C | C | C | T |
| 3' UTR 27696-28029 |   |   |   |   |   |   |   |   | a Nucleotides are numbered according to the PEDV 2014020697-P5 sequences (SEQ ID NO:8).
b Only nonsynonymous mutations are shown and silent mutations are not shown. Amino acids of replicase proteins are numbered according to their locations in the replicase polyprotein pp1ab. Amino acids of structural proteins are numbered according to their location in the respective structural protein.

Fig. 24B

Amino acid changes

| Genome region/protein | Genome structure[a] | Study | | | | | | | |
|---|---|---|---|---|---|---|---|---|---|
| | | Clone or Consensus | | | B2478 | B2533 Clone | B2533 Clone | B2533 Clone | |
| | | Position in Protein[b] | P5 Consensus | P7R1 Consensus | P8R1 Consensus | P18R1 89G8b | P18R1 94F6a | P18R1 92F6a | P45 Consensus |
| 5'UTR | 1-292 | | | | | | | | |
| ORF1a/1b | 293-12616 / 12616-20637 | 551 | L | L | L | L | | | L |
| | | 1591 | K | K | K | K | K | K | M |
| | | 5087 | V | V | V | V | V | V | S |
| | | 6138 | N | N | N | N | N | N | S |
| S/Spike | 20634-24785 | 48 | V | L | L | L | L | L | V |
| | | 345 | A | V | V | V | V | V | A |
| | | 884 | S | S | S | S | S | S | R |
| | | 959 | V | V | V | V | V | V | A |
| | | 973 | Y | Y | Y | | | | Y |
| | | 1009 | S | P | P | P | P | P | S |
| | | 1225 | V | V | V | V | V | V | D |
| | | 1272 | I | T | T | T | T | T | I |
| ORF3 | 24785-25459 | 8 | Y | Y | Y | Y | Y | Y | * |
| Envelope | 25440-25670 | 138 | YYDGKSI | LTANPL* | LTANPL* | LTANPL* | LTANPL* | LTANPL* | * |
| Membrane | 25678-26358 | | | | | | | | |
| Nucleocapsid | 26370-27695 | 62 | S | S | S | S | S | S | F |
| 3'UTR | 27696-28029 | 27 | D | H | H | H | H | H | D | a Genome structure numbered according to the PEDV USA/IL20697/2014 sequences
b Only nonsynonymous mutations are shown and silent mutations are not shown. Amino acids of structural proteins are numbered according to their location in the resp

Fig. 25A >USA/IL/2014/20697-P45 genomic sequence (SEQ ID NO:39)
ACTTAAAAAGATTTTCTATCTACGGATAGTTAGCTCTTTTTCTAGACTCTTGTCTACTCAATTCAACTAAACGA
AATTTTGTCCTTCCGGCCGCATGTCCATGCTGCTGGAAGCTGACGTGGAATTTCATTAGGTTTGCTTAAGTAGC
CATCGCAAGTGCTGTGCTGTCCTCTAGTTCCTGGTTGGCGTTCCGTCGCCTTCTACATACTAGACAAACAGCCT
TCCTCCGGTTCCGTCTGGGGGTTGTGTGGATAACTAGTTCCGTCTAGTTTGAAACCAGTAACTGTCGGCTATGG
CTAGCAACCATGTTACATTGGCTTTTGCCAATGATGCAGAAATTTCAGCTTTTGGCTTTTGCACTGCTAGTGAA
GCCGTCTCATACTATTCTGAGGCCGCCGCTAGTGGATTTATGCAATGCCGTTTCGTGTCCTTCGATCTCGCTGA
CACTGTTGAGGGATTGCTTCCCGAAGACTATGTCATGGTGGTGGTCGGCACTACCAAGCTTAGTGCGTATGTGG
ACACTTTTGGTAGCCGCCCCAAAAACATTTGTGGTTGGCTGTTATTTTCTAACTGTAATTACTTCCTCGAAGAG
TTAGAGCTTACTTTTGGTCGTCGTGGTGGTAACATCGTGCCAGTTGACCAATACATGTGTGGCGCTGACGGTAA
ACCTGTTCTTCAGGAATCCGAATGGGAGTATACAGATTTCTTTGCTGACTCCGAAGACGGTCAACTCAACATTG
CTGGTATCACTTATGTGAAGGCCTGGATTGTAGAGCGATCTGATGTCTCTTATGCGAGTCAGAATTTAACATCT
ATTAAGTCTATTACTTACTGTTCAACCTATGAGCATACTTTTCCTGATGGTACTGCCATGAAGGTTGCACGTAC
TCCAAAGATTAAGAAGACTGTTGTCTTGTCTGAGCCACTTGCTACTATCTACAGGGAAATTGGTTCTCCTTTTG
TGGATAATGGGAGCGATGCTCGTTCTATCATTAAGAGACCAGTGTTCCTCCACGCTTTTGTTAAGTGTAAGTGT
GGTAGTTATCATTGGACTGTTGGTGATTGGACTTCCTATGTCTCCACTTGCTGTGGCTTTAAGTGTAAGCCAGT
CCTTGTGGCTTCATGCTCTGCTACGCCTGGTTCTGTTGTGGTTACGCGCGCTGGTGCTGGCACTGGTGTTAAGT
ATTACAACAACATGTTCCTGCGCCATGTGGCAGACATTGATGGGTTGGCATTCTGGCGAATTCTCAAGGTGCAG
TCCAAAGACGACCTCGCTTGCTCTGGTAAATTCCTTGAACACCATGAGGAAGGTTTCACAGATCCTTGCTACTT
TTTGAATGACTCGAGCATTGCTACTAAGCTCAAGTTTGACATCCTTAGTGGCAAGTTTTCTGATGAAGTCAAAC
AAGCTATCTTTGCTGGTCATGTTGTTGTTGGCAGCGCGCTCGTTGACATTGTTGACGATGCACTGGGACAGCCT
TGGTTTATACGTAAGCTTGGTGACCTTGCAAGTGCAGCTTGGGAGCAGCTTAAGGCTGTCGTTAGAGGCCTTAA
CCTCCTGTCTGATGAGGTCGTGCTCTTTGGCAAAAGACTTAGCTGTGCCACTCTTAGTATCGTTAACGGTGTTT
TTGAGTTCATCGCCGAAGTGCCTGAGAAGTTGGCTGCGGCTGTTACAGTTTTTGTCAACTTCTTGAATGAGCTT
TTTGAGTCTGCCTGTGACTGCTTAAAGGTCGGAGGTAAAACCTTTAACAAGGTTGGCTCTTATGTTCTTTTTGA
CAACGCATTGGTTAAGCTTGTCAAGGCAAAAGTTCGCGGCCCACGACAGGCAGGTGTTTGTGAAGTTCGTTACA
CAAGCCTTGTTATTGGGAGTACTACCAAGGTGGTTTCCAAGCGCGTTGAAAATGCCAATGTGAATCTCGTCGTC
GTTGACGAGGATGCGACCCTCAACACCACTGGTCGTACAGTTGTTGTTGACGGACTTGCATTCTTCGAGAGTGA
CGGGTTTTACAGACATCTTGCTGATGCTGACGTTGTCATTGAACATCCTGTTTATAAGTCTGCTTGTGAGCTCA
AGCCAGTTTTCGAGTGTGACCCAATACCTGATTTTCCTATGCCTGTGGCCGCTAGTGTTGCAGAGCTTTGTGTG
CAAACTGATCTGTTGCTTAAAAATTACAACACTCCTTATAAAACTTACAGCTGCGTTGTGAGAGGTGATAAGTG
TTGTATCACTTGTACCTTACATTTCACAGCACCAAGTTATATGGAGGCTGCTGCTAATTTTGTAGACCTCTGTA
CCAAGAACATTGGTACTGCTGGTTTTCATGAGTTTTACATTACGGCCCATGAACAACAGGATCTGCAAGGGTTT
GTAACCACTTGTTGCACGATGTCAGGTTTTGAGTGTTTTATGCCTATAATCCCACAGTGTCCAGCAGTGCTTGA
AGAGATTGATGGTGGTAGCATCTGGCGGTCTTTTATCACTGGTCTTAATACAATGTGGGATTTTGCAAGCATC
TTAAAGTCAGCTTTGGACTAGATGGCATTGTTGTCACTGTAGCACGCAAATTTAAACGACTTGGTGCTCTCTTG
GCAGAAATGTATAACACTTACCTTTCAACTGTGGTGGAAAACTTGGTACTGGCCGGTGTTAGCTTCAAGTATTA
TGCCACCAGTGTCCCAAAAATTGTTTTGGGCTGTTGTTTTCACAGTGTTAAAAGTGTTCTTGCAAGTGCCTTCC
AGATTCCTGTCCAGGCAGGCGTTGAGAAGTTTAAAGTCTTCCTTAACTGTGTTCACCCTGTTGTACCACGTGTC
ATTGAAACTTCTTTTGTGGAATTAGAAGAGACGACATTTAAACCACCAGCACTCAATGGTAGTATTGCTATTGT
TGATGGCTTTGCTTTCTATTATGATGGAACACTATACTATCCCACCGATGGTAATAGCGTTGTTCCTATCTGCT
TTAAGAAGAAGGTGGTGGTGATGTCAAATTCTCTGATGAAGTCTCTGTTAAAACCATTGACCCAGTTTATAAG
GTCTCCCTTGAATTTGAGTTCGAGTCTGAGACTATTATGGCTGTGCTTAATAAGGCTGTTGGTAATTGTATCAA
GGTTACAGGTGGTTGGGACGATGTTGTGAGTATATCAATGTTGCCATTGAGGTTCTTAAAGATCACATCGATG
TGCCTAAGTACTACATCTATGATGAGGAAGGTGGCACCGATCCTAATCTGCCCGTAATGGTTTCTCAGTGGCCG
TTGAATGATGACACGATCTCACAGGATCTGCTTGATGTTGAAGTTGTTACTGATGCGCCAGTTGATTTCGAGGG
TGATGAAGTAGACTCCTCTGACCCTGATAAGGTGGCAGACGTGGCTAACTCTGAGCCTGAGGATGACGGTCTTA
ATGTAGCTCCTGAAACAAATGTAGAGTCTGAAGTTGAGGAAGTTGCCGCAACCTTGTCCTTTATTAAAGATACA
CCTTCCACAGTTACTAAGGATCCTTTTGCTTTTGACTTTGCAAGCTATGGAGGACTTAAGGTTTTAAGACAATC
TCATAACAACTGCTGGGTTACTTCTACCTTGGTGCAGCTACAATTGCTTGGCATCGTCGATGACCCTGCAATGG
AGCTTTTTAGTGCTGGTAGAGTTGGTCCAATGGTTCGCAAATGCTATGAGTCACAAAAGGCTATCTTGGGATCT
TTGGGTGATGTGTCGGCTTGCCTAGAGTCTCTGACTAAGGACCTACACACACTTAAGATTACCTGTTCTGTAGT
CTGTGGTTGTGGTACTGGTGAACGTATCTATGATGGTTGTGCTTTTCGTATGACGCCAACTTTGGAACCGTTCC
CATATGGTGCTTGTGCTCAGTGTGCTCAAGTTTTGATGCACACTTTTAAAAGTATTGTTGGCACCGGCATCTTT

Fig. 25B

```
TGTCGAGATACTACTGCTCTCTCCTTGGATTCTTTGGTTGTAAAACCTCTTTGTGCGGCTGCTTTTATAGGCAA
GGATAGTGGTCATTATGTCACTAACTTTTATGATGCTGCTATGGCTATTGATGGTTATGGTCGTCATCAGATAA
AGTATGACACACTGAACACTATTTGTGTTAAAGACGTTAATTGGACAGCACCTTTTGTCCCAGACGTTGAGCCT
GTATTGGAGCCTGTTGTCAAACCTTTCTATTCTTATAAGAATGTTGATTTTTACCAAGGAGATTTTAGTGACCT
TGTTAAACTTCCATGTGATTTTGTTGTTAATGCTGCAAATGAGAATTTGTCTCACGGTGGCGGCATAGCAAAGG
CCATTGATGTTTATACCAGGGGCATGTTGCAGAAGTGCTCGAATGATTACATTAAAGCACACGGTCCCATTAAA
GTTGGACGTGGTGTCATGTTGGAGGCATTAGGTCTTAAGGTCTTTAATGTTGTTGGTCCACGTAAGGGTAAGCA
TGCACCTGAGCTTCTTGTTAAGGCTTATAAGTCCGTTTTGCTAATTCAGGTGTTGCTCTTACACCTTTGATTA
GTGTTGGAATTTTTAGTGTTCCTTTGGAAGAATCTTTATCTGCTTTTCTTGCATGTGTTGGTGATCGCCACTGT
AAGTGCTTTTGTTATAGTGACAAAGAGCGCGAGGCGATCATTAATTACATGGATGGCTTGGTAGATGCTATTTT
CAAAGATGCACTTGTTGATACTACTCCTGTCCAGGAAGATGTTCAACAAGTTTCACAAAAACCAGTTTTGCCTA
ATTTTGAACCTTTCAGGATTGAAGGTGCTCATGCTTTCTATGAGTGCAACCCTGAAGGTTTGATGTCATTAGGT
GCTGACAAGCTGGTGTTGTTTACAAATTCCAATTTGGATTTTTGTAGCGTTGGTAAGTGTCTTAACAATGTGAC
TGGCGGTGCATTGCTTGAAGCCATAAATGTATTTAAAAAGAGTAACAAAACAGTGCCTGCTGGCAACTGTGTTA
CTTTTGAGTGTGCAGATATGATTTCTATTACTATGGTAGTATTGCCATCTGACGGTGATGCTAATTATGACAAA
AATTATGCACGCGCCGTCGTCAAGGTATCTATGCTTAAAGGCAAGTTATTGCTTGCTGTTGGTGATGCCATGTT
GTATTCCAAGTTGTCCCACCTCAGCGTGTTAGGTTTCGTATCCACACCTGATGATGTGGAGCGTTTCTACGCAA
ATAAGAGTGTGGTTATTAAAGTTACTGAGGATACACGTAGTGTTAAGACTGTTAAAGTAGAATCCACTGTTACT
TATGGACAACAAATTGGACCTTGTCTTGTTAATGACACCGTTGTCACAGACAACAAACCTGTTGTTGCTGATGT
TGTAGCTAAGGTTGTACCAAGTGCTAATTGGGATTCACATTATGGTTTTGATAAGGCTGGTGAGTTCCACATGC
TAGACCATACTGGGTTTGCCTTTCCTAGTGAAGTTGTTAACGGTAGGCGTGTGCTTAAAACCACAGATAATAAC
TGTTGGGTTAATGTTACATGTTTACAATTACAGTTTGCTAGATTTAGGTTCAAGTCAGCAGGTCTACAGGCTAT
GTGGGAGTCCTATTGTACTGGTGATGTTGCTATGTTTGTGCATTGGTTGTACTGGCTTACTGGTGTTGACAAAG
GTCAGCCTAGTGATTCAGAAAATGCACTTAACATGTTGTCTAAGTACATTGTTCCTGCTGGTTCTGTCACTATT
GAACGTGTCACGCATGACGGTTGTTGTTGTAGTAAGCGTGTTGTCACTGCACCAGTTGTGAATGCTAGCGTGTT
GAAGCTTGGCGTCGAGGATGGTCTTTGTCCACATGGTCTTAACTACATTGACAAAGTTGTTGTAGTTAAAGGTA
CTACAATTGTTGTCAATGTTGGAAAACCTGTAGTGGCACCATCGCACCTCTTTCTTAAGGGTGTTTCCTACACA
ACATTCCTAGATAATGGTAACGGTGTTGCCGGCCATTATACTGTTTTTGATCATGACACTGGTATGGTGCATGA
TGGAGATGTTTTTGTACCAGGTGATCTCAATGTGTCTCCTGTTACAAATGTTGTCGTCTCAGAGCAGACGGCTG
TTGTGATTAAAGACCCTGTGAAGAAAGTAGAGTTAGACGCTACAAAGCTGTTAGACACTATGAATTATGCATCG
GAAAGATTCTTTTCCTTTGGTGATTTTATGTCACGTAATTTAATTACAGTGTTTTGTACATCCTTAGTATTTT
GGGTCTCTGTTTTAGGGCCTTTCGTAAGAGGGATGTTAAAGTTCTAGCTGGTGTACCCCAACGTACTGGTATTA
TATTGCGTAAAAGTGTGCGCTATAATGCAAAGGCTTTGGGTGTCTTCTTCAAGCTAAAACTTTATTGGTTCAAA
GTCCTTGGTAAGTTTAGTTTGGGTATTTATGCATTGTATGCATTACTATTCATGACAATACGCTTTACACCTAT
AGGTGGCCCTGTTTGTGATGATGTTGTTGCTGGTTATGCTAATTCTAGTTTTGACAAGAATGAGTATTGCAACA
GTGTTATTTGTAAGGTCTGTCTCTATGGGTACCAGGAACTTTCGGACTTCTCTCACACACAGGTAGTATGGCAA
CACCTTAGAGACCCATTAATTGGTAATGTGATGCCTTTCTTTTATTTGGCATTTCTGGCAATTTTTGGGGGTGT
TTATGTAAAGGCTATTACTCTCTATTTTATTTTCCAGTACCTTAACATTCTTGGTGTGTTTTGGGCCTACAAC
AGTCCATTTGGTTTTTGCAGCTTGTGCCTTTTGATGTCTTTGGTGACGAGATCGTCGTCTTTTTCATCGTTACA
CGCGTATTGATGTTCCTTAAGCATGTTTTCCTTGGCTGCGATAAGGCATCTTGTGTGGCTTGCTCTAAGAGTGC
TCGCCTTAAGCGCGTTCCTGTCCAGACTATTTTTCAGGGTACTAGCAAATCCTTCTACGTACATGCCAATGGTG
GTTCTAAGTTCTGTAAGAAGCACAATTTCTTTTGTTTAAATTGTGATTCTTATGGTCCAGGCTGCACTTTTATT
AATGACGTCATTGCAACTGAAGTTGGTAATGTTGTCAAACTTAATGTGCAACCGACAGGTCCTGCCACTATTCT
TATTGACAAGGTTGAATTCAGTAATGGTTTTTACTATCTTTATAGTGGTGACACATTTTGGAAGTACAACTTTG
ACATAACAGATAACAAATACACTTGCAAAGAGTCACTTAAAAATTGTAGCATAATCACAGACTTTATTGTTTTT
AACAATAATGGTTCCAATGTAAATCAGGTTAAGAATGCATGTGTGTATTTTTCACAGATGCTTTGTAAACCTGT
TAAGTTAGTGGACTCAGCGTTGTTGGCCAGTTTGTCTGTTGATTTTGGTGCAAGCTTACATAGTGCTTTTGTTA
GTGTGTTGTCGAATAGTTTTGGCAAAGACCTGTCGAGTTGTAATGACATGCAGGATTGCAAGAGCACATTGGGT
TTTGATGATGTACCATTGGATACCTTTAATGCTGCTGTTGCTGAGGCTCATCGTTACGATGTCCTCTTGACTGA
CATGTCGTTCAACAATTTTACCACCAGTTATGCAAAACCAGAGGAAAAACTTCCCGTCCATGACATTGCCACGT
GTATGCGTGTAGGTGCCAAGATTGTTAATCATAACGTTCTTGTCAAGGATAGTATACCTGTGGTGTGGCTTGTA
CGTGATTTCATTGCCCTTTCTGAAGAAACTAGGAAGTACATTATTCGTACGACTAAAGTTAAGGGTATAACCTT
CATGTTGACCTTTAATGATTGTCGTATGCATACTACCATACCTACTGTTTGCATTGCAAATAAGAAGGGTGCAG
GTCTTCCTAGTTTTTCAAAGGTTAAGAAATTCTTCTGGTTTTTGTGTCTGTTCATAGTTGCTGTTTTCTTTGCA
```

Fig. 25C

```
CTAAGCTTTTTTGATTTTAGTACTCAGGTTAGCAGTGATAGTGATTATGACTTCAAGTATATTGAGAGTGGCCA
GTTGAAGACTTTTGACAATCCACTTAGTTGTGTGCATAATGTCTTTAGTAACTTCGACCAGTGGCATGATGCCA
AGTTTGGTTTCACCCCCGTCAACAATCCTAGTTGTCCTATAGTCGTTGGTGTATCAGACGAAGCGCGCACTGTT
CCAGGTATCCCAGCAGGTGTTTATTTAGCTGGTAAAACACTTGTTTTTGCTATTAACACCATTTTTGGTACATC
TGGTTTGTGCTTTGATGCTAGTGGCGTTGCTGATAAGGGCGCTTGCATTTTAATTCGGCTTGCACCACATTAT
CTGGTTTGGGTGGAACTGCTGTCTACTGTTATAAGAATGGTCTAGTTGAAGGTGCTAAACTTTATAGTGAGTTG
GCACCTCATAGCTACTATAAAATGGTAGATGGTAATACTGTGTCTTTACCTGAAATTATCTCACGCGGCTTTGG
CATCCGTACTATCCGTACAAAGGCTATGACCTACTGTCGCGTTGGCCAGTGTGTGCAATCTGCAGAAGGTGTTT
GTTTTGGCGCCGATAGATTCTTTGTCTATAATGCAGAATCTGGTTCTGACTTTGTTTGTGGCACAGGGCTCTTT
ACATTGTTGATGAACGTTATTAGTGTTTTTTCCAAGACAGTACCAGTAACTGTGTTGTCTGGTCAAATACTTTT
TAATTGCATTATTGCTTTTGCTGCTGTTGCGGTGTGTTTCTTATTTACAAAGTTTAAGCGCATGTTCGGTGATA
TGTCTGTTGGCGTTTTCACTGTCGGTGCTTGTACTTTGTTGAACAATGTTTCCTACATTGTAACACAGAACACA
CTTGGCATGTTGGGCTATGCAACTTTGTACTTTTTGTGCACTAAAGGTGTTAGATATATGTGGATTTGGCATTT
GGGATTTTTGATCTCATATATACTTATTGCACCATGGTGGGTTTTGATGGTTTATGCCTTTTCAGCCATTTTTG
AGTTTATGCCTAACCTTTTTAAGCTTAAGGTTTCAACACAACTTTTTGAGGGTGACAAGTTCGTAGGCTCTTTT
GAAAATGCTGCAGCAGGTACATTTGTGCTTGATATGCATGCCTATGAGAGACTTGCCAACTCTATCTCAACTGA
AAAACTGCGTCAGTATGCTAGTACTTACAATAAGTACAAGTATTATTCAGGCAGTGCTTCAGAGGCTGATTACA
GGCTTGCTTGTTTTGCCCATTTGGCCAAGGCTATGATGGATTATGCTTCTAATCACAACGACACGTTATACACA
CCACCCACTGTGAGTTACAATTCAACTCTACAGGCTGGCTTGCGTAAGATGGCACAACCATCTGGTGTTGTTGA
GAAGTGCATAGTTCGTGTTTGCTATGGTAATATGGCTCTTAATGGCCTATGGCTTGGTGATACTGTTATCTGCC
CACGCCATGTTATAGCGTCTAGTACTACTAGCACTATAGATTATGACTATGCCCTTTCTGTTTTACGCCTCCAC
AACTTCTCCATTTCATCTGGTAATGTTTTCCTAGGTGTTGTGGGTGTAACCATGCGAGGTGCTTTGTTGCAGAT
AAAGGTTAATCAAAACAATGTCCACACGCCTAAGTACACCTATCGCACAGTTAGACCGGGTGAATCTTTTAATA
TCTTGGCGTGCTATGATGGTTCTGCAGCTGGTGTTTACGGCGTTAACATGCGCTCTAATTACACTATTAGAGGC
TCGTTCATTAATGGCGCTTGTGGTTCACCTGGTTATAACATTAACAATGGTACCGTTGAGTTTTGCTATTTACA
CCAGCTTGAACTTGGTTCAGGCTGTCATGTTGGTAGCGACTTAGATGGTGTTATGTATGGTGGTTATGAGGACC
AACCTACTTTGCAAGTTGAAGGCGCTAGTAGTCTGTTTACAGAGAATGTGTTGGCATTTCTTTATGCAGCACTC
ATTAATGGTTCTACCTGGTGGCTTAGTTCTTCTAGGATTGCTGTAGACAGGTTTAATGAGTGGGCTGTTCATAA
TGGTATGACAACAGTAGTTAATACTGATTGCTTTTCTATTCTTGCTGCTAAGACTGGTGTTGATGTACAACGTT
TGTTGGCCTCAATCCAGTCTCTGCATAAGAATTTTGGTGGAAAGCAAATTCTTGGCTATACCTCGTTGACAGAT
GAGTTTACTACAGGTGAAGTTATACGTCAAATGTATGGCGTTAATCTTCAGAGTGGTTATGTTTCACGCGCCTG
TAGAAATGTCTTGCTGGTTGGTTCTTTTCTGACTTTCTTTTGGTCAGAATTAGTTTCCTACACTAAGTTCTTTT
GGGTAAATCCTGGTTATGTCACACCTATGTTTGCGTGTTTGTCATTGCTGTCCTCACTTTTGATGTTCACACTC
AAGCATAAGACATTGTTTTTCCAGGTCTTTCTAATACCTGCTCTGATTGTTACATCTTGCATTAATTTGGCATT
TGATGTTGAAGTCTACAACTATTTGGCAGAGCATTTTGATTACCATGTTTCTCTCATGGGTTTTAATGCACAAG
GTCTTGTTAACATCTTTGTCTGCTTTGTTGTTACCATTTTACACGGCACATACACATGGCGCTTTTTAACACA
CCTGTGAGTTCTGTCACTTATGTGGTAGCTTTGCTGACTGCGGCATATAACTATTTTACGCTAGTGACATTCT
TAGTTGTGCTATGACACTATTTGCTAGTGTGACTGGCAACTGGTTCGTTGGTGCTGTTTGTTATAAAGCTGCTG
TTTATATGGCCTTGAGATTTCCTACTTTTGTGGCTATTTTTGGTGATATTAAGAGTGTTATGTTCTGTTACCTT
GTGTTGGGTTATTTTACCTGTTGCTTCTACGGTATTCTCTACTGGTTCAACAGGTTTTTTAAGGTTAGTGTAGG
TGTCTATGACTATACTGTTAGTGCTGCTGAGTTTAAGTATATGGTTGCTAACGGCCTACGTGCACCAACTGGAA
CACTTGATTCACTACTTCTGTCTGCCAAATTGATTGGTATTGGTGGTGAGCGGAATATTAAGATTTCTTCCGTT
CAGTCTAAACTGACTGATATTAAGTGTAGTAACGTTGTGCTTTTAGGCTGTCTTTCTAGCATGAATGTTTCAGC
AAATTCAACAGAATGGGCCTATTGTGTTGACTTGCATAACAAGATCAACTTGTGTAATGACCCAGAAAAAGCGC
AGGAAATGCTACTTGCTTTGTTGGCATTTTCCTTAGTAAGAATAGTGCTTTTGGTTTAGATGACTTATTGGAA
TCCTATTTTAATGACAATAGTATGTTGCAGAGTGTTGCATCTACTTATGTCGGTTGCCTTCTTATGTCATTTA
TGAAAATGCACGCCAACAGTATGAAGATGCTGTTAATAATGGTTCTCCACCTCAGTTGGTTAAGCAATTGCGCC
ATGCCATGAATGTAGCAAAGAGCGAATTTGACCGTGAGGCTTCTACTCAGCGTAAGCTTGATAGAATGGCGGAA
CAGGCTGCAGCACAGATGTACAAAGAGGCACGAGCAGTTAATAGGAAGTCCAAAGTTGTAAGTGCTATGCATTC
ACTGCTTTTGGTATGTTGAGACGTTTGGACATGTCTTCTGTAGACACCATTCTCAACTTGGCAAAGGATGGGG
TTGTACCTCTGTCTGTCATACCGGCAGTCAGTGCTACTAAGCTTAACATTGTTACTTCTGATATCGATTCTTAT
AATCGTATCCAGCGTGAGGGATGTGTCCACTACGCTGGTACCATTTGGAATATAATTGATATCAAGGACAATGA
TGGCAAGGTGGTACACGTTAAGGAGGTAACCGCACAGAATGCTGAGTCCCTGTCATGGCCCCTGGTCCTTGGGT
GTGAGCGTATTGTCAAGCTCCAGAATAATGAAATTATTCCTGGTAAGCTGAAGCAGCGCTCCATTAAGGCAGAA
```

Fig. 25D

```
GGAGATGGCATAGTTGGAGAAGGTAAGGCACTTTACAATAATGAGGGTGGACGTACTTTTATGTATGCTTTCAT
CTCGGACAAACCGGACCTGCGTGTAGTCAAGTGGGAGTTCGATGGTGGTTGTAACACTATTGAGCTAGAACCAC
CACGTAAGTTCTTGGTGGATTCTCCTAATGGTGCACAGATCAAGTATCTCTACTTTGTTCGTAACCTTAACACG
TTACGTAGGGGTGCTGTTCTCGGCTACATAGGTGCCACTGTACGCTTGCAGGCTGGTAAACAAACAGAACAGGC
TATTAACTCTTCATTGTTGACACTTTGCGCTTTCGCTGTGGATCCTGCTAAGACCTACATCGATGCTGTCAAAA
GTGGTCACAAACCAGTAGGTAACTGTGTTAAGATGTTGGCCAATGGTTCTGGTAATGGACAAGCTGTTACTAAT
GGTGTGGAGGCTAGTACTAACCAGGATTCATACGGTGGTGCGTCCGTGTGTCTATATTGTAGAGCACATGTTGA
GCATCCATCTATGGATGGTTTTTGCAGACTGAAAGGCAAGTACGTACAGGTTCCACTAGGTACAGTGGATCCTA
TACGTTTTGTACTTGAGAATGACGTTTGCAAGGTTTGTGGTTGTTGGCTGGCTAATGGCTGCACTTGTGACAGA
TCCATTATGCAAAGCACTGATATGGCTTATTTAAACGAGTACGGGGCTCTAGTGCAGCTCGACTAGAGCCCTGT
AACGGTACTGATACACAACATGTGTATCGTGCTTTTGACATCTACAACAAGGATGTTGCTTGTCTAGGTAAATT
CCTCAAGGTGAACTGTGTTCGCCTGAAGAATTTGGATAAGCATGATGCATTCTATGTTGTCAAAAGATGTACCA
AGTCTGCGATGGAACACGAGCAATCCATCTATAGCAGACTTGAAAAGTGTGGAGCCGTAGCCGAACACGATTTC
TTCACTTGGAAGGATGGTCGTGCAATCTATGGTAACGTTTGTAGAAAGGATCTTACCGAGTATACTATGATGGA
TTTGTGTTACGCTTTACGTAACTTTGATGAAAACAATTGCGATGTTCTTAAGAGCATTTTAATTAAGGTAGGCG
CTTGTGAGGAGTCCTACTTCAATAATAAAGTCTGGTTTGACCCTGTTGAAAATGAAGACATTCATCGTGTTTAT
GCATTGTTAGGTACCATTGTTTCACGTGCTATGCTTAAATGCGTTAAGTTCTGTGATGCAATGGTTGAACAAGG
TATAGTTGGTGTTGTCACATTAGATAATCAGGATCTTAATGGTGATTTTATGATTTTGGTGATTTTACTTGTA
GCATCAAGGGAATGGGTATACCCATTTGCACATCATATTACTCTTATATGATGCCTGTTATGGGTATGACTAAT
TGCCTTGCTAGTGAGTGTTTTGTTAAGAGTGATATATTTGGTGAGGATTTCAAGTCATATGACCTGTTGGAATA
TGATTTCACGGAGCATAAGACAGCACTCTTCAACAAGTATTTCAAGTATTGGGACTGCAATACCACCCTAACT
GTGTGGACTGCAGTGATGAGCAGTGCATAGTTCACTGTGCCAATTTCAATACGTTGTTTTCCACTACTATACCT
ATTACGGCATTTGGACCTTTGTGTCGCAAGTGTTGGATTGATGGTGTTCCACTGGTAACTACAGCTGGTTATCA
TTTTAAACAGTTAGGTATAGTTTGGAACAATGACCTCAACTTACACTCTAGCAGGCTCTCTATTAACGAACTAC
TCCAGTTTTGTAGTGATCCTGCATTGCTTATAGCATCATCACCAGCCCTTGTTGATCAGCGTACTGTTTGCTTT
TCAGTTGCAGCGCTAGGTACAGGTATGACTAACCAGACTGTTAAACCTGGCCATTTCAATAAGGAGTTTTATGA
CTTCTTACTTGAGCAAGGTTTCTTTTCTGAGGGCTCTGAGCTTACTTTAAAGCACTTCTTCTTTGCACAGAAGG
GTGATGCAGCTGTTAAGGATTTTGACTACTATAGGTATAATAGACCTACTGTTCTGGACATTTGCCAAGCTCGC
GTCGTTTATCAAATAGTGCAACGCTATTTTGATATTTACGAAGGTGGTTGTATCACTGCTAAAGAAGTGGTTGT
TACAAACCTTAACAAGAGCGCAGGTTATCCTTTGAACAAGTTTGGTAAAGCTGGTCTTTACTATGAGTCTTTAT
CCTATGAGGAACAGGATGAACTTTATGCTTATACTAAGCGTAACATCCTGCCCACTATGACACAGCTCAACCTT
AAATATGCTATAAGTGGCAAAGAACGTGCACGCACAGTGGGTGGTGTTTCGCTTTTGTCAACCATGACTACTCG
GCAGTATCACCAGAAACACCTTAAGTCCATAGTTAATACTAGGGGCGCTTCGGTTGTTATTGGTACTACTAAGT
TTTATGGTGGTTGGGACAATATGCTTAAGAACCTTATTGATGGTGTCGAAAATCCGTGTCTTATGGGTTGGGAT
TACCCAAAGTGCGACAGAGCACTGCCCAATATGATACGCATGATTTCAGCCATGATTTTAGGCTCTAAGCACAC
CACATGCTGCAGTTCCACTGACCGCTTTTTCAGGTTGTGCAATGAATTGGCTCAAGTCCTTACTGAGGTTGTTT
ATTCTAATGGAGGTTTTTATTTGAAGCCAGGTGGTACTACCTCTGGTGATGCAACCACCGCATATGCAAACTCA
GTTTTCAATATCTTCCAAGCAGTAAGTGCCAATGTTAACAAACTTCTTAGTGTTGACAGCAATGTCTGTCATAA
TTTAGAAGTTAAGCAATTGCAGCGTAAGCTTTATGAGTGCTGTTATAGATCAACTACCGTTGATGACCAGTTCG
TCGTTGAGTATTATGGTTACTTGCGTAAACATTTTTCAATGATGATTCTTTCTGATGATGGCGTTGTTTGTTAC
AACAATGACTATGCATCACTTGGTTATGTCGCTGATCTTAACGCATTCAAGGCTGTTTTGTATTACCAGAACAA
TGTCTTCATGAGCGCCTCTAAATGTTGGATCGAGCCTGACATTAATAAGGTCCTCATGAATTTTGCTCGCAGC
ATACTATGCAGATTGTCGATAAAGATGGTACTTACTACCTACCTTACCCTGATCCTTCAAGAATCCTCTCTGCA
GGTGTGTTTGTTGACGACGTTGTTAAAACTGATGCAGTTGTATTGCTTGAACGTTATGTGTCATTGGCTATAGA
TGCCTACCCGTTATCTAAGCATGAAAACCCTGAATATAAGAAGGTGTTTTATGTGCTTTTGGATTGGGTTAAGC
ACCTGTATAAAACTTTGAATGCTGGTGTGTTAGAGTCTTTTTCTGTCACACTTTTGGAAGATTCTACTGCTAAA
TTCTGGGATGAGAGCTTTTATGCCAACATGTATGAGAAATCTGCAGTTTTGCAATCTGCAGGGCTTTGTGTTGT
TTGTGGCTCTCAAACTGTTTACGTTGTGGTGATTGTCTACGGCGTCCTATGCTTTGTACTAAGTGTGCTTATG
ATCATGTCATTGGAACAACTCACAAGTTCATTTTGGCCATCACTCCATATGTGTTGTGCTTCAGATTGTGGT
GTCAATGATTCAACTAAGCTCTATTTAGGTGGTCTTAGTTATTGGTGTCATGACCACAAGCCACGTCTTGCATT
CCCGTTGTGCTCTGCTGGTAATGTTTTTGGCTTGTACAAAAATTCTGCTACCGGCTCACCCGATGTTGAAGACT
TTAATCGCATTGCTACATCCGATTGGACTGATGTTTCTGACTACAGGTTGGCAAATGATGTCAAGGACTCATTG
CGTCTGTTTGCAGCGGAAACTATCAAGGCCAAGGAGGAGAGCGTTAAGTCATCCTATGCTTGTGCAACACTACA
TGAGGTTGTAGGACCTAAAGAGTTGTTGCTCAAATGGGAAGTCGGCAGACCCAAACCACCCCTTAATAGAAATT
```

Fig. 25E

```
CGGTTTTCACTTGTTATCATATAACGAAGAACACCAAATTTCAAATCGGTGAGTTTGTGTTTGAGAAGGCAGAA
TATGATAATGATGCTGTAACATATAAAACTACCGCCACAACAAAACTTGTTCCTGGCATGGTTTTTGTGCTTAC
CTCACATAATGTTCAGCCATTGCGCGCACCGACCATTGCTAACCAAGAACGTTATTCCACTATACATAAGTTGC
ATCCTGCTTTTAACATACCTGAAGCTTATTCTAGCTTAGTGCCCTATTACCAATTGATTGGTAAGCAGAAGATT
ACAACTATTCAGGGACCTCCCGGTAGTGGTAAATCTCACTGTGTTATAGGGCTAGGTTTGTACTATCCAGGTGC
ACGTATAGTGTTTACAGCTTGTTCTCATGCAGCGGTCGATTCACTTTGTGTGAAAGCTTCCACTGCTTATAGCA
ATGACAAATGTTCACGCATCATACCACAGCGCGCTCGTGTTGAGTGTTATGATGGTTTCAAGTCTAATAATACT
AGTGCTCAGTACCTTTTCTCTACTGTCAATGCTTTGCCAGAGTGCAATGCGGACATTGTTGTGGTGGATGAGGT
CTCTATGTGCACTAATTATGACTTGTCTGTCATAAATCAGCGCATCAGCTATAGGCATGTAGTCTATGTTGGTG
ACCCTCAACAGCTGCCTGCACCACGTGTTATGATTTCACGTGGTACTTTGGAACCAAAGGACTACAACGTTGTC
ACTCAACGCATGTGTGCCCTTAAGCCTGATGTTTCTTGCACAAGTGTTATCGCTGTCCTGCTGAGATAGTGCG
TACTGTGTCTGAGATGGTCTATGAAAACCAATTCATTCCTGTGCACCCAGATAGCAAGCAGTGTTTTAAAATCT
TTTGCAAGGGTAATGTTCAGGTTGATAATGGTTCAAGCATTAATCGCAGGCAATTGGATGTTGTGCGTATGTTT
TTGGCTAAAAATCCTAGGTGGTCAAAGGCTGTTTTTATTTCTCCTTATAACAGCCAGAATTATGTTGCCAGCCG
CATGCTAGGTCTACAAATTCAGACAGTTGACTCATCCCAGGGTAGTGAGTATGACTATGTCATTTACACACAAA
CTTCAGATACTGCCCATGCCTGTAATGTTAACAGGTTTAATGTTGCCATCACAAGGGCCAAGAAAGGCATATTA
TGTATAATGTGCGATAGGTCCCTTTTTGATGTGCTTAAATTCTTTGAGCTTAAATTGTCTGATTTGCAGGCTAA
TGAGGGTTGTGGTCTTTTAAAGACTGTAGCAGAGGTGATGATCTGTTGCCACCATCTCACGCTAACACCTTCA
TGTCTTTAGCGGACAATTTTAAGACTGATCAAGATCTTGCTGTTCAAATAGGTGTTAATGGACCCATTAAATAT
GAGCATGTTATCTCGTTTATGGGTTTCCGTTTGATATCAACATACCCAACCATCATACTCTCTTTTGCACACG
CGACTTTGCCATGCGCAATGTTAGAGGTTGGTTAGGCTTTGACGTTGAAGGAGCACATGTTGTTGGCTCTAACG
TCGGTACAAATGTCCCATTGCAATTAGGGTTTTCTAACGGTGTTGATTTTGTTGTCAGACCTGAAGGTTGCGTT
GTAACAGAGTCTGGTGACTACATTAAACCCGTCAGAGCTCGTGCTCCACCAGGGGAACAATTCGCACACCTTTT
GCCTTTACTTAAACGCGGCCAACCATGGGATGTTGTCCGCAAACGTATAGTGCAGATGTGTAGTGACTACCTGG
CCAACCTATCAGACATACTAATTTTTGTGTTGTGGGCTGGTGGTTTGGAGTTGACAACTATGCGTTATTTTGTC
AAGATTGGACCAAGTAAGAGTTGTGATTGTGGTAAGGTTGCTACTTGTTACAATAGTGCGCTGCATACGTACTG
TTGTTTCAAACATGCCCTTGGTTGTGATTATCTGTATAACCCATACTGTATTGATATACAGCAGTGGGGATACA
AGGGATCACTTAGCCTTAACCACCATGAGCATTGTAATGTACATAGAAACGAGCATGTGGCTTCTGGTGATGCC
ATAATGACTCGCTGTCTGGCCATACATGATTGCTTTGTCAAGAACGTTGACTGGTCCATCACATACCCATTTAT
TGGTAATGAGGCTGTTATTAATAAGAGCGGCCGAATTGTGCAATCACACACTATGCGGTCAGTTCTTAAGTTAT
ACAATCCGAAAGCCATATATGATATTGGCAATCCTAAGGGCATTAGATGTGCCGTAACGGATGCTAAGTGGTTT
TGCTTTGACAAGAATCCTACTAATTCTAATGTCAAGACATTGGAGTATGACTATATAACACATGGCCAATTTGA
TGGGTTGTGCTTGTTTTGGAATTGCAATGTAGACATGTATCCAGAATTTTCTGTGGTCTGTCGTTTTGATACTC
GCTGTAGGTCACCACTCAACTTGGAGGGTTGTAATGGTGGTTCACTGTATGTTAATAATCATGCATTCCATACA
CCGGCTTTTGACAAGCGTGCTTTTGCTAAGTTGAAGCCAATGCCATTTTTCTTTTATGATGATACTGAGTGTGA
CAAGTTACAGGACTCCATAAACTATGTTCCTCTTAGGGCTAGTAACTGCATTACTAAATGTAATGTTGGTGGTG
CTGTCTGTAGTAAGCATTGTGCTATGTATCATAGCTATGTTAATGCTTACAACACTTTTACGTCGGCGGGCTTT
ACTATTTGGGTGCCTACTTCGTTTGACACCTATAATCTGTGGCAGACATTTAGTAGCAATTTGCAAGGTCTTGA
GAACATTGCTTTCAATGTCGTAAAGAAAGGATCTTTTGTTGGTGCCGAAGGTGAACTTCCTGTAGCTGTGGTTA
ATGACAAAGTGCTCGTTAGAGATGGTACTGTTGATACTCTTGTTTTACAAACAAGACATCACTACCCACTAAC
GTAGCTTTTGAGTTGTATGCCAAGCGTAAGGTAGGACTCACCCCACCCATTACGATCCTACGTAACTTGGGTGT
AGTTTGTACATCTAAGTGTGTCATTTGGGACTATGAAGCCGAACGTCCACTTACTACTTTTACAAAGGATGTTT
GTAAATATACCGACTTTGAGGGTGACGTCTGTACACTCTTTGATAACAGCATTGTTGGTTCATTAGAGCGATTC
TCCATGACCCAAAATGCTGTGCTTATGTCACTTACAGCTGTTAAAAAGCTTACTGGCATAAAGTTAACTTATGG
TTATCTTAATGGTGTCCCAGTTAACACACATGAAGATAAACCTTTTACTTGGTATATTTACACTAGGAAGAACG
GCAAGTTCGAGGACCATCCTGATGGCTATTTTACCCAAGGTAGAACAACCGCTGATTTAGCCCTCGTAGCGAC
ATGGAAAAGGACTTCCTAAGTATGGATATGGGTCTGTTTATTAACAAGTACGGACTTGAAGATTACGGCTTTGA
GCACGTTGTGTATGGTGATGTTTCTAAAACCACCCTTGGTGGTTTACATCTACTAATTTCGCAGGTGCGTCTGG
CCTGTATGGGTGTGCTTAAAATAGACGAGTTTGTGTCTAGTAATGATAGCACGTTAAAGTCTTGTACTGTTACA
TATGCTGATAACCCTAGTAGTAAGATGGTTTGCACGTATATGGATCTCCTTCTTGACGATTTGTCAGCATTCT
TAAATCGTTGGATTTGAGTGTTGTATCTAAAGTTCATGAAGTTATGGTCGATTGTAAAATGTGGAGGTGGATGT
TGTGGTGTAAGGATCATAAACTCCAGACATTTATCCGCAACTTCAGGCCAGTGAATGGAAATGTGGTTATTCC
ATGCCTTCTATTTACAAGATACAACGTATGTGTTTAGAACCTTGCAACCTCTATAACTATGGTGCTGGTATTAA
GTTACCTGATGGCATTATGTTTAACGTAGTTAAATATACACAGCTTTGTCAATATCTTAATAGCACCACAATGT
```

Fig. 25F

```
GTGTACCCCATCACATGCGCGTGCTACATCTTGGTGCTGGCTCCGACAAGGGTGTTGCACCTGGCACGGCTGTC
TTACGACGTTGGTTGCCACTGGATGCCATTATAGTTGACAATGATAGTGTGGATTACGTTAGCGATGCTGATTA
TAGTGTTACGGGAGATTGCTCTACCTTATACCTGTCAGATAAGTTTGACTTAGTTATATCTGATATGTATGATG
GTAAGATTAAAAGTTGTGATGGGGAGAACGTGTCTAAAGAAGGCTTCTTTCCCTATATTAATGGTGTCATCACT
GAAAAGTTGGCACTTGGTGGTACTGTAGCTATTAAGGTGACGGAGTTTAGTTGGAATAAGAAGTTGTATGAACT
CATTCAGAAGTTTGAGTATTGGACAATGTTCTGTACCAGTGTTAACACGTCATCGTCAGAGGCATTTTAATTG
GTGTTCACTATTTAGGTGATTTTGCAAGTGGCGCTGTGATTGACGGCAACACTATGCATGCCAATTATATCTTC
TGGCGTAATTCCACAATTATGACTATGTCTTACAATAGTGTACTTGATTTAAGCAAGTTCAATTGTAAGCATAA
GGCTACAGTTGTTATTAATTTAAAAGATTCATCCATTAGTGATGTTGTGTTAGGTTTGTTGAAGAATGGTAAGT
TGCTAGTGCGTAATAATGACGCCATTTGTGGTTTTTCTAATCATTTGGTCAACGTAAACAAATGAAGTCTTTAA
ATTACTTCTGGTTGTTCTTACCAGTACTTTCAACACTCAGCCTACCACAAGATGTCACTAGGTGCCAGTCTACT
ATTAACTTCAGGCGGTTCTTTTCAAAATTTAATGTGCAGGCACCTGCTGTCGTTGTGTTGGGTGGTTATCTACC
TAGTATGAACTCCTCTAGCTGGTACTGTGGCACAGGTCTTGAAACTGCTAGTGGCGTGCATGGTATTTTCCTCA
GTTACATCGATGCTGGTCAGGGCTTTGAGATTGGCATTTCACAGGAGCCGTTTGATCCTAGTGGTTACCAGCTT
TATTTACATAAGGCCACTAATGGTAACCATAATGCTATTGCACGACTGCGCATTTGCCAGTTTCCAGATAATAA
AACATTGGGCCCTACTGTTAATGATGTTACAACAGGTCGTAACTGCCTATTCAACAAAGCCATTCCAGCTTATA
TGCAGGATGGAAAAAATATCGTTGTCGGCATAACATGGGACAATGATCGTGTCACTGTTTTTGCTGACAAGATC
TATCATTTTATCTTAAAAATGATTGGTCCCGTGTTGCGACAAGATGTTACAATAAAAGAAGTTGTGCTATGCA
ATATGTTTATACACCTACCTACTACATGCTTAATGTTACTAGTGCAGGTGAGGATGGCATTTATTATGAACCAT
GTACAGCTAATTGCAGTGGTTACGCTGCCAATGTGTTTGCCACTGATTCTAATGGCCACATACCAGAAGGTTTT
AGTTTTAATAATTGGTTTCTTTTGTCCAATGATTCCACTTTGTTGCATGGTAAGGTGGTTTCCAACCAACCTTT
GTTGGTCAATTGTCTTTTGGCCATTCCTAAGATTTATGGACTAGGCCAATTTTTCTCATTCAATCAAACGATGG
ATGGCGTTTGTAATGGAGCTGCTGCGCAGCGTGCACCAGAGGCTCTGAGGTTTAATATTAATGACACCTCTGTC
ATTCTTGCTGAAGGCTCAATTGTACTTCATACTGCTTTAGGAACAAATCTTTCTTTTGCTTGCAGTAATTCTTC
AGATCCTCATCTAGCTACCTTCGCCATACCTCTGGGTGCTACCCAAGTACCTTATTATTGTTTTCTTAAAGTGG
ATACTTACAACTCCACTGTTTATAAATTTTTGGCTGTTTTACCTCCTACCGTCAGGGAAATTGTCATCACCAAG
TATGGTGATGTTTATGTCAATGGGTTTGGATACTTGCATCTCGGTTTGTTGGATGCTGTCACAATTAATTTCAC
TGGTCATGGCACTGACGATGATGTTTCTGGTTTTTGGACCATAGCATCGACTAATTTTGTTGATGCACTCATCG
AAGTTCAAGGAACCGCCATTCAGCGTATTCTTTATTGTGATGATCCTGTTAGCCAACTCAAGTGTTCTCAGGTT
GCTTTTGACCTTGACGATGGTTTTTACCCTATTTCTTCTAGAAACCTTCTGAGTCATGAACAGCCAATTTCTTT
TGTTACTCTGCCATCATTTAATGATCATTCTTTTGTTAACATTACTGTATCTGCTTCCTTTGGTGGTCATAGTG
GTGCCAACCTTATTGCATCTGACACTACTATCAATGGGTTTAGTTCTTTCTGTGTTGACACTAGACAATTTACC
ATTTCACTGTTTTATAACGTTACAAACAGTTATGGTTATGTGTCTAAATCACAGGACAGTAATTGCCCTTTCAC
CTTGCAATCTGTTAATGATTACCTGTCTTTTAGCAAATTTTGTGTTTCCACCAGCCTTTTGGCTAGTGCCTGTA
CCATAGATCTTTTTGGTTACCCTGAGTTTGGTAGTGGTGTTAAGTTTACGTCCCTTTACTTTCAATTCACAAAG
GGTGAGTTGATTACTGGCACGCCTAAACCACTTGAAGGTGTCACGGACGTTTCTTCTATGACTCTGGATGTGTG
TACCAAGTATACTATCTATGGCTTTAAAGGTGAGGGTATCATTACCCTTACAAATTCTAGCTTTTGGCAGGTG
TTTATTACACATCTGATTCTGGACAGTTGTTAGCCTTTAAGAATGTCACTAGTGGTGCTGTTTATTCTGTTACG
CCATGTTCTTTTTCAGAGCAGGCTGCATATGTTGATGATGATATAGTGGGTGTTATTTCTAGTTTGTCTAGCTC
CACTTTTAACAGTACTAGGGAGTTGCCTGGTTTCTTCTACCATTCTAATGATGGCTCTAATTGTACAGAGCCTG
TGTTGGTGTATAGTAACATAGGTGTTTGTAAATCTGGCAGTATTGGCTACGTTCCATCTCAGTCTGGTCAAGTC
AAGATTGCACCCACGGTTACTGGGAATATTAGTATTCCCACCAACTTTAGTATGAGTATTAGGACAGAATATTT
ACAGCTTTACAACACGCCTGTTAGTGTTGATTGTGCCACATATGTTTGTAATGGTAACTCTCGTTGTAAACAAT
TACTCACCCAGTACACTGCAGCATGTAAGACCATAGAGTCAGCATTACAACTCAGCGCTAGGCTTGAGTCTGTT
GAAGTTAACTCTATGCTTACTATTTCTGAAGAGGCTCTACAGTTAGCTACCATTAGTTCGTTTAATGGTGATGG
ATATAATTTTACTAATGTGCTGGGTGTTTCTGTGTATGATCCTGCACGTGGCAGGTGGTACAAAAAAGGTCTT
TTATTGAAGACCTGCTTTTTAATAAAGTGGTTACTAATGGCCTTGGTACTGTTGATGAAGACTATAAGCGCTGT
TCTAATGGTCGCTCTGTGGCAGATCTAGTCTGTGCACAGTATTACTCTGGTGTCATGGTACTACCTGGTGTTGT
TGACGCTGAGAAGCTTCACATGTATAGTGCGTCTCTCATCGGTGGTATGGCGCTAGGAGGTTTTACTTCTGCAG
CGGCATTGCCTTTTAGCTATGCTGTTCAAGCTAGACTCAATTATCTTGCTCTACAGACGGATGTTCTACAGCGG
AACCAGCAATTGCTTGCTGAGTCTTTTAACTCTGCTATTGGTAATATAACTTCAGCCTTTGAGAGTGTTAAAGA
GGCTATTAGTCAAACTTCCAAGGGTTTGAACACTGTGGCTCATGCGCTTACTAAGGTTCAAGAGGTTGTTAACT
CGCAGGGTGCAGCTTTGACTCAACTTACCGTACAGCTGCAACACAACTTCCAAGCCATTTCTAGTTCTATTGAT
GACATTTACTCTCGACTGGACATTCTTTCAGCCGATGTTCAGGTTGACCGTCTCATCACCGGCAGATTATCAGC
```

Fig. 25G

```
ACTTAATGCTTTTGTTGCTCAAACCCTCACTAAGTATACTGAGGTTCAGGCTAGCAGGAAGTTAGCACAGCAAA
AGGTTAATGAGTGCGTTAAATCGCAATCTCAGCGTTATGGTTTTTGTGGTGGTGATGGCGAGCACATTTTCTCT
CTGGTACAGGCAGCACCTCAGGGCCTGCTGTTTTTACATACAGTACTTGTACCGAGTGATTTTGTAGATGTTAT
TGCCATCGCTGGCTTATGCGTTAACGATGAAATTGCCTTGACTCTACGTGAGCCTGGCTTAGTCTTGTTTACGC
ATGAACTTCAAAATCATACTGCGACGGAATATTTTGTTTCATCGCGACGTATGTTTGAACCTAGAAAACCTACC
GTTAGTGATTTTGTTCAAATTGAGAGTTGTGTGGACACCTATGTCAATTTGACTAGAGACCAACTACCAGATGT
AATCCCAGATTACATCGATGTTAACAAAACACTTGATGAGATTTTAGCTTCTCTGCCCAATAGAACTGGTCCAA
GTCTTCCTTTAGATGTTTTTAATGCCATTTATCTTAATCTCACTGGTGAAATTGCAGATTTAGAGCAGCGTTCA
GAGTCTCTCCGTAATACTACAGAGGAGCTTCAAAGTCTTATATATAATATCAACAACACACTAGTTGACCTTGA
GTGGCTCAACCGAGTTGAGACATATATCAAGTGGCCGTGGTGGGTTTGGTTGATTATTTTCATTGTTCTCATCT
TTGTTGTGTCATTACTAGTGTTCTGCTGCATTTCCACGGGTTGTTGTGGATGCTGCGGCTGCTGCTGTGCTTGT
TTCTCAGGTTGTTGTAGGGGTCCTAGACTTCAACCTTACGAAGTTTTTGAAAAGGTCCACGTGCAGTGATGTTT
CTTGGACTTTTTCAATAGTCAAAGATGTCTCAAAGTCTGCTAACTTGTCTTTGGATGCTGTCCAAGAGTTGGAG
CTCAATGTAGTTCCAATTAGACAAGCTTCAAATGTGACGGGTTTTCTTTTCACCAGTGTTTTATCTACTTCTT
TGCACTGTTTAAAGCGTCTTCTTTGAGGCGCAATTATATTATGTTGGCAGCGCGTTTTGCTGTCATTGTTCTTT
ATTGCCCACTTTTATATTATTGTGGTGCATTTTAGATGCAACTATTATTTGTTGCACACTTATTGGCAGGCTT
TGTTTAGTCTGCTTTTACTCCTGGCGCTATAAAAATGCGCTCTTTATTATTTTAATACTACGACACTTTCTTT
CCTCAATGGTAAAGCAGCTTATGACGGCAAATCCATTGTGATTTTAGAAGGTGGTGACCATTACATCACTTTTG
GCAACTCCTTTGTTGCTTTTGTTAGTAGCATTGACTTGTATCTAGCTATACAAGAAGCTTTATGTCTTTTCGCA
ACATCAAATTGTTGGCATTACTAATGCTGCATTTGACTCAATTCAACTAGACGAGTATGCTACAATTAGTGAAT
GATAATGGTCTAGTAGTTAATGTTATACTTTGGCTTTTCGTACTCTTTTTCCTGCTTATTATAAGCATTACTTT
CGTCCAATTGGTTAATCTGTGCTTCACTTGTCACCGGTTGTGTAATAGCGCAGTTTACACACCTATAGGGCGTT
TGTATAGAGTTTATAAGTTTTACATGCAAATAGACCCCTCCCTAGTACTGTTATTGACGTATAAACGAAATAT
GTCTAACGGTTCTATTCCCGTTGATGAGGTGATTCAACACCTTAGAAACTGGAATTTCACATGGAATATCATAC
TGACGATACTACTTGTAGTGCTTCAGTATGGCCATTACAAGTACTCTGCGTTCTTGTATGGTGTCAAGATGGCT
ATTCTATGGATACTTTGGCCTCTTGTGTTAGCACTGTCACTTTTTGATGCATGGGCTAGCTTTCAGGTCAATTG
GGTCTTTTTTGCTTTCAGCATCCTTATGGCTTGCATCACTCTTATGCTGTGGATAATGTACTTTGTCAATAGCA
TTCGGTTGTGGCGCAGGACACATTCTTGGTGGTCTTTCAATCCTGAAACAGACGCGCTTCTCACTACTTCTGTG
ATGGGCCGACAGGTCTGCATTCCAGTGCTTGGAGCACCAACTGGTGTAACGCTAACACTCCTTAGTGGTACATT
GCTTGTAGAGGGCTATAAGGTTGCTACTGGCGTACAGGTAAGTCAATTACCTAATTTCGTCACAGTCGCCAAGG
CCACTACAACAATTGTCTACGGACGTATTGGTCGTTCAGTCAATGCTTCATCTGGCACTGGTTGGGCTTTCTAT
GTCCGGTCCAAACACGGCGACTACTCAGCTGTGAGTAATCCGAGTTCGGTTCTCACAGATAGTGAGAAAGTGCT
TCATTTAGTCTAAACAGAAACTTTATGGCTTCTGTCAGTTTTCAGGATCGTGGCCGCAAACGGGTGCCATTATC
CCTCTATGCCCCTCTTAGGGTTACTAATGACAAACCCCTTTCTAAGGTACTTGCAAATAATGCTGTACCCACTA
ATAAAGGAAATAAGGACCAGCAAATTGGATACTGGACTGAGCAAATTCGCTGGCGCATGCGCCGTGGTGAGCGA
ATTGAACAACCTTCCAATTGGCATTTCTACTACCTCGGAACAGGACCTCACGCCGACCTCCGCTATAGGACTCG
TACTGAGGGTGTTTTCTGGGTTGCTAAAGAAGGCGCAAAGACTGAACCCACTAACCTGGGTGTCAGAAAGGCGT
CTGAAAAGCCAATTATTCCAAATTTCTCTCAACAGCTTCCCAGCGTAGTTGAGATTGTTGAACCTAACACACCT
CCTACTTCACGTGCAAATTCACGTAGCAGGAGTCGTGGTAATGGCAACAACAGGTCCAGATCTCCAAGTAACAA
TAGAGGCAATAACCAGTCCCGCGGTAATTCACAGAATCGTGGAAATAACCAGGGTCGTGGAGCTTCTCAGAACA
GAGGAGGCAATAATAATAACAATAACAAGTCTCGTAACCAGTCCAAGAACAGAAACCAGTCAAATGACCGTGGT
GGTGTAACATCACGCGATGATCTGGTGGCTGCTGTCAAGGATGCCCTTAAATCTTTGGGTATTGGCGAAAACCC
TGACAAGCTTAAGCAACAGCAGAAGCCCAAACAGGAAAGGTCTGACAGCAGCGGCAAAAATACACCTAAGAAGA
ACAAATCCAGAGCCACTTCGAAAGAACGTGACCTCAAAGACATCCCAGAGTGGAGGAGAATTCCAAGGGCGAA
AATAGCGTAGCAGCTTGCTTCGGACCCAGGGGAGGCTTCAAAAATTTTGGAGATGCGGAATTTGTCGAAAAAGG
TGTTGATGCCTCAGGCTATGCTCAGATCGCCAGTTTAGCACCGAATGTTGCAGCATTGCTCTTTGGTGGTAATG
TGGCTGTTCGTGAGCTAGCGGACTCTTACGAGATTACATATAATTATAAAATGACTGTGCCAAAGTCTGATCCA
AATGTAGAGCTTCTTGTTTCACAGGTGGATGCATTTAAAACTGGGAATGCAAAACCCCAGAGAAAGAAGGAAAA
GAAGAACAAGCGTGAAACCACGCAGCAGCTGAATGAAGAGGCCATCTACGATGATGTGGGTGTGCCATCTGATG
TGACTCATGCCAATTTGGAATGGGACACAGCTGTTGATGGTGGTGACACGGCCGTTGAAATTATCAACGAGATC
TTCGACACAGGAAATTAAACAATGTTTGACTGGCTTATCCTGGCTATGTCCCAGGGTAGTGCCATTACACTGTT
ATTACTGAGTGTTTTTCTAGCGACTTGGCTGCTGGGCTATGGCTTTGCCCTCTAACTAGCGGTCTTGGTCTTGC
ACACAACGGTAAGCCAGTGGTAATGTCAGTGCAAGAAGGATATTACCATAGCACTGTCATGAGGGGAACGCAGT
```

Fig. 25H

ACCTTTTCATCTAAACCTTTGCACGAGTAATCAAAGATCCGCTTGACGAGCCTATATGGAAGAGCGTGCCAGGT
ATTTGACTCAAGGACTGTTAGTAACTGAAGACCTGACGGTGTTGATATGGATACAC

```
                                        9910      9920      9930      9940      9950      9960      9970      9980      9990     10000
                                    ....|....|....|....|....|....|....|....|....|....|....|....|....|....|....|....|....|....|....|....|
USA/IL/2014/20697_P5                TCTTTATGCAGCACTCAATTAATGTTCTACCTGGTGGCTTAGTTCTTCTGTAGGATTGCTGTAGAGACAGGTTTAATGAGTGGGCTGTTCATAATGGTATGACA
USA/IL/2014/20697_P7                ....................................................................................................
USA/IL/2014/20697_P8                ....................................................................................................
USA/IL/2014/20697_P18-89G8b         ....................................................................................................
USA/IL/2014/20697_p18-94F6a         ....................................................................................................
USA/IL/2014/20697_P18-92F6a         ....................................................................................................
USA/IL/2014/20697_P45               ....................................................................................................
Clustal Consensus                   ****************************************************************************************************

10010     10020     10030     10040     10050     10060     10070     10080     10090     10100
                                    ....|....|....|....|....|....|....|....|....|....|....|....|....|....|....|....|....|....|....|....|
USA/IL/2014/20697_P5                ACAGTAGTAATACTGATTGCTTTTCTATTCTTGCTGCTAAGACTGGTGTTGATGGATGTACAACGTTTGTTGGCCTCAATCCAGTCTCTGCATAAGAATTTTG
USA/IL/2014/20697_P7                ....................................................................................................
USA/IL/2014/20697_P8                ....................................................................................................
USA/IL/2014/20697_P18-89G8b         ....................................................................................................
USA/IL/2014/20697_p18-94F6a         ....................................................................................................
USA/IL/2014/20697_P18-92F6a         ....................................................................................................
USA/IL/2014/20697_P45               ....................................................................................................
Clustal Consensus                   ****************************************************************************************************

10110     10120     10130     10140     10150     10160     10170     10180     10190     10200
                                    ....|....|....|....|....|....|....|....|....|....|....|....|....|....|....|....|....|....|....|....|
USA/IL/2014/20697_P5                GTGGAAAGCAAATTCTTGGCTATACCTCGTTGACAGATGAGTTTACTACAGGTGAAGTTATACGTCAAATGTATGGCGTTAAATCTTCAGAGTGGTTATGT
USA/IL/2014/20697_P7                ....................................................................................................
USA/IL/2014/20697_P8                ....................................................................................................
USA/IL/2014/20697_P18-89G8b         ....................................................................................................
USA/IL/2014/20697_p18-94F6a         ....................................................................................................
USA/IL/2014/20697_P18-92F6a         ....................................................................................................
USA/IL/2014/20697_P45               ....................................................................................................
Clustal Consensus                   ****************************************************************************************************

10210     10220     10230     10240     10250     10260     10270     10280     10290     10300
                                    ....|....|....|....|....|....|....|....|....|....|....|....|....|....|....|....|....|....|....|....|
USA/IL/2014/20697_P5                TTCACGCGCCTGTGAGAAATGTCTGCTGGTTGGTTCTTTTCTGACTTTCTTTTTGCTCAGAATTAGTTTCCTACACTAAGTCTTTGGGTAAATCCTGGT
USA/IL/2014/20697_P7                ....................................................................................................
USA/IL/2014/20697_P8                ....................................................................................................
USA/IL/2014/20697_P18-89G8b         ....................................................................................................
USA/IL/2014/20697_p18-94F6a         ....................................................................................................
USA/IL/2014/20697_P18-92F6a         ....................................................................................................
USA/IL/2014/20697_P45               ....................................................................................................
Clustal Consensus                   ****************************************************************************************************
```

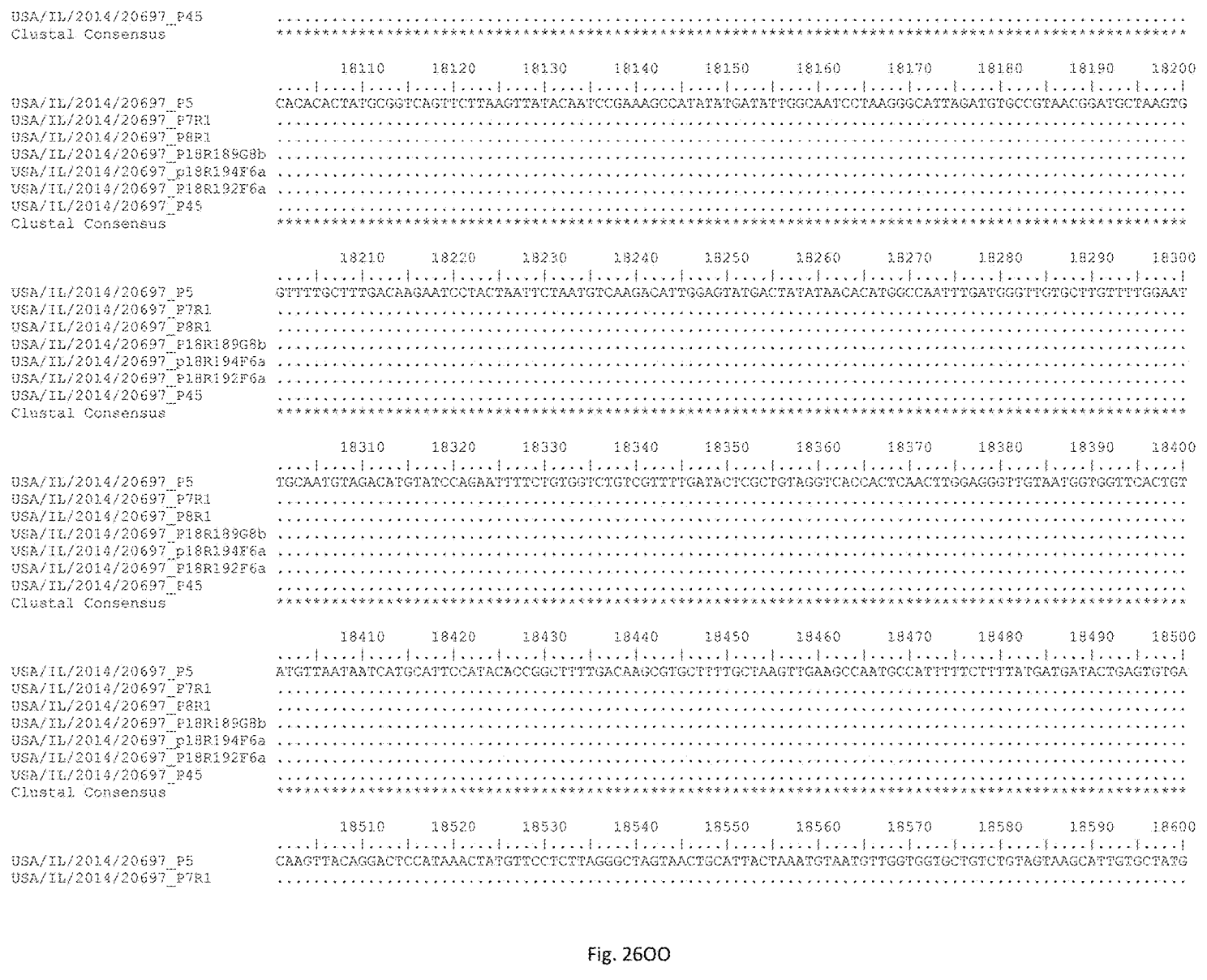

```
>USA/IL/2014/20697-P45 ORF1a/1b polyprotein (SEQ ID NO:40)
MASNHVTLAFANDAEISAFGFCTASEAVSYYSEAASGFMQCRFVSFDLADTVEGLLPEDYVMVVVGTTKLSAYVDTFGS
RPKNICGWLLFSNCNYFLEELELTFGRRGGNIVPVDQYMCGADGKPVLQESEWEYTDFFADSEDGQLNIAGITYVKAWIV
ERSDVSYASQNLTSIKSITYCSTYEHTFPDGTAMKVARTPKIKKTVVLSEPLATIYREIGSPFVDNGSDARSIIKRPVFL
HAFVKCKCGSYHWTVGDWTSYVSTCCGFKCKPVLVASCSATPGSVVVTRAGAGTGVKYYNNMFLRHVADIDGLAFWRILK
VQSKDDLACSGKFLEHHEEGFTDPCYFLNDSSIATKLKFDILSGKFSDEVKQAIFAGHVVVGSALVDIVDDALGQPWFIR
KLGDLASAAWEQLKAVVRGLNLLSDEVVLFGKRLSCATLSIVNGVFEFIAEVPEKLAAAVTVFVNFLNELFESACDCLKV
GGKTFNKVGSYVLFDNALVKLVKAKVRGPRQAGVCEVRYTSLVIGSTTKVVSKRVENANVNLVVVDEDATLNTTGRTVVV
DGLAFFESDGFYRHLADADVVIEHPVYKSACELKPVFECDPIPDFPMPVAASVAELCVQTDLLLKNYNTPYKTYSCVVRG
DKCCITCTLHFTAPSYMEAAANFVDLCTKNIGTAGFHEFYITAHEQQDLQGFVTTCCTMSGFECFMPIIPQCPAVLEEID
GGSIWRSFITGLNTMWDFCKHLKVSFGLDGIVVTVARKFKRLGALLAEMYNTYLSTVVENLVLAGVSFKYYATSVPKIVL
GCCFHSVKSVLASAFQIPVQAGVEKFKVFLNCVHPVVPRVIETSFVELEETTFKPPALNGSIAIVDGFAFYYDGTLYYPT
DGNSVVPICFKKGGGDVKFSDEVSVKTIDPVYKVSLEFEFESETIMAVLNKAVGNCIKVTGGWDDVVEYINVAIEVLKD
HIDVPKYYIYDEEGGTDPNLPVMVSQWPLNDDTISQDLLDVEVVTDAPVDFEGDEVDSSDPDKVADVANSEPEDDGLNVA
PETNVESEVEEVAATLSFIKDTPSTVTKDPFAFDFASYGGLKVLRQSHNNCWVTSTLVQLQLLGIVDDPAMELFSAGRVG
PMVRKCYESQKAILGSLGDVSACLESLTKDLHTLKITCSVVCGCGTGERIYDGCAFRMTPTLEPFPYGACAQCAQVLMHT
FKSIVGTGIFCRDTTALSLDSLVVKPLCAAAFIGKDSGHYVTNFYDAAMAIDGYGRHQIKYDTLNTICVKDVNWTAPFVP
DVEPVLEPVVKPFYSYKNVDFYQGDFSDLVKLPCDFVVNAANENLSHGGGIAKAIDVYTRGMLQKCSNDYIKAHGPIKVG
RGVMLEALGLKVFNVVGPRKGKHAPELLVKAYKSVFANSGVALTPLISVGIFSVPLEESLSAFLACVGDRHCKCFCYSDK
EREAIINYMDGLVDAIFKDALVDTTPVQEDVQQVSQKPVLPNFEPFRIEGAHAFYECNPEGLMSLGADKLVLFTNSNLDF
CSVGKCLNNVTGGALLEAINVFKKSNKTVPAGNCVTFECADMISITMVVLPSDGDANYDKNYARAVVKVSMLKGKLLLAV
GDAMLYSKLSHLSVLGFVSTPDDVERFYANKSVVIKVTEDTRSVKTVKVESTVTYGQQIGPCLVNDTVVTDNKPVVADVV
AKVVPSANWDSHYGFDKAGEFHMLDHTGFAFPSEVVNGRRVLKTTDNNCWVNVTCLQLQFARFRFKSAGLQAMWESYCTG
DVAMFVHWLYWLTGVDKGQPSDSENALNMLSKYIVPAGSVTIERVTHDGCCCSKRVVTAPVVNASVLKLGVEDGLCPHGL
NYIDKVVVVKGTTIVVNVGKPVVAPSHLFLKGVSYTTFLDNGNGVAGHYTVFDHDTGMVHDGDVFVPGDLNVSPVTNVVV
SEQTAVVIKDPVKKVELDATKLLDTMNYASERFFSFGDFMSRNLITVFLYILSILGLCFRAFRKRDVKVLAGVPQRTGII
LRKSVRYNAKALGVFFKLKLYWFKVLGKFSLGIYALYALLFMTIRFTPIGGPVCDDVVAGYANSSFDKNEYCNSVICKVC
LYGYQELSDFSHTQVVWQHLRDPLIGNVMPFFYLAFLAIFGGVYVKAITLYFIFQYLNILGVFLGLQQSIWFLQLVPFDV
FGDEIVVFFIVTRVLMFLKHVFLGCDKASCVACSKSARLKRVPVQTIFQGTSKSFYVHANGGSKFCKKHNFFCLNCDSYG
PGCTFINDVIATEVGNVVKLNVQPTGPATILIDKVEFSNGFYYLYSGDTFWKYNFDITDNKYTCKESLKNCSIITDFIVF
NNNGSNVNQVKNACVYFSQMLCKPVKLVDSALLASLSVDFGASLHSAFVSVLSNSFGKDLSSCNDMQDCKSTLGFDDVPL
DTFNAAVAEAHRYDVLLTDMSFNNFTTSYAKPEEKLPVHDIATCMRVGAKIVNHNVLVKDSIPVVWLVRDFIALSEETRK
YIIRTTKVKGITFMLTFNDCRMHTTIPTVCIANKKGAGLPSFSKVKKFFWFLCLFIVAVFFALSFFDFSTQVSSDSDYDF
KYIESGQLKTFDNPLSCVHNVFSNFDQWHDAKFGFTPVNNPSCPIVVGVSDEARTVPGIPAGVYLAGKTLVFAINTIFGT
SGLCFDASGVADKGACIFNSACTTLSGLGGTAVYCYKNGLVEGAKLYSELAPHSYYKMVDGNTVSLPEIISRGFGIRTIR
TKAMTYCRVGQCVQSAEGVCFGADRFFVYNAESGSDFVCGTGLFTLLMNVISVFSKTVPVTVLSGQILFNCIIAFAAVAV
CFLFTKFKRMFGDMSVGVFTVGACTLLNNVSYIVTQNTLGMLGYATLYFLCTKGVRYMWIWHLGFPLISYILIAPWWVLMV
YAFSAIFEFMPNLFKLKVSTQLFEGDKFVGSFENAAAGTFVLDMHAYERLANSISTEKLRQYASTYNKYKYYSGSASEAD
YRLACFAHLAKAMMDYASNHNDTLYTPPTVSYNSTLQAGLRKMAQPSGVVEKCIVRVCYGNMALNGLWLGDTVICPRHVI
ASSTTSTIDYDYALSVLRLHNFSISSGNVFLGVVGVTMRGALLQIKVNQNNVHTPKYTYRTVRPGESFNILACYDGSAAG
VYGVNMRSNYTIRGSFINGACGSPGYNINNGTVEFCYLHQLELGSGCHVGSDLDGVMYGGYEDQPTLQVEGASSLFTENV
LAFLYAALINGSTWWLSSSRIAVDRFNEWAVHNGMTTVVNTDCFSILAAKTGVDVQRLLASIQSLHKNFGGKQILGYTSL
TDEFTTGEVIRQMYGVNLQSGYVSRACRNVLLVGSFLTFFWSELVSYTKFFWVNPGYVTPMFACLSLLSSLLMFTLKHKT
LFFQVFLIPALIVTSCINLAFDVEVYNYLAEHFDYHVSLMGFNAQGLVNIFVCFVVTILHGTYTWRFFNTPVSSVTYVVA
LLTAAYNYFYASDILSCAMTLFASVTGNWFVGAVCYKAAVYMALRFPTFVAIFGDIKSVMFCYLVLGYFTCCFYGILYWF
NRFFKVSVGVYDYTVSAAEFKYMVANGLRAPTGTLDSLLLSAKLIGIGGERNIKISSVQSKLTDIKCSNVVLLGCLSSMN
VSANSTEWAYCVDLHNKINLCNDPEKAQEMLLALLAFFLSKNSAFGLDDLLESYFNDNSMLQSVASTYVGLPSYVIYENA
RQQYEDAVNNGSPPQLVKQLRHAMNVAKSEFDREASTQRKLDRMAEQAAAQMYKEARAVNRKSKVVSAMHSLLFGMLRRL
DMSSVDTILNLAKDGVVPLSVIPAVSATKLNIVTSDIDSYNRIQREGCVHYAGTIWNIIDIKDNDGKVVHVKEVTAQNAE
SLSWPLVLGCERIVKLQNNEIIPGKLKQRSIKAEGDGIVGEGKALYNNEGGRTFMYAFISDKPDLRVVKWEFDGGCNTIE
LEPPRKFLVDSPNGAQIKYLYFVRNLNTLRRGAVLGYIGATVRLQAGKQTEQAINSSLLTLCAFAVDPAKTYIDAVKSGH
KPVGNCVKMLANGSGNGQAVTNGVEASTNQDSYGGASVCLYCRAHVEHPSMDGFCRLKGKYVQVPLGTVDPIRFVLENDV
CKVCGCWLANGCTCDRSIMQSTDMAYLNRVRGSSAARLEPCNGTDTQHVYRAFDIYNKDVACLGKFLKVNCVRLKNLDKH
DAFYVVKRCTKSAMEHEQSIYSRLEKCGAVAEHDFFTWKDGRAIYGNVCRKDLTEYTMMDLCYALRNFDENNCDVLKSIL
IKVGACEESYFNNKVWFDPVENEDIHRVYALLGTIVSRAMLKCVKFCDAMVEQGIVGVVTLDNQDLNGDFYDFGDFTCSI
KGMGIPICTSYYSYMMPVMGMTNCLASECFVKSDIFGEDFKSYDLLEYDFTEHKTALFNKYFKYWGLQYHPNCVDCSDEQ
CIVHCANFNTLFSTTIPITAFGPLCRKCWIDGVPLVTTAGYHFKQLGIVWNNDLNLHSSRLSINELLQFCSDPALLIASS
PALVDQRTVCFSVAALGTGMTNQTVKPGHFNKEFYDFLLEQGPFSEGSELTLKHFFAQKGDAAVKDFDYYRYNRPTVLD
ICQARVVYQIVQRYFDIYEGGCITAKEVVVTNLNKSAGYPLNKFGKAGLYYESLSYEEQDELYAYTKRNILPTMTQLNLK
```

Fig. 27B

YAISGKERARTVGGVSLLSTMTTRQYHQKHLKSIVNTRGASVVIGTTKFYGGWDNMLKNLIDGVENPCLMGWDYPKCDRA
LPNMIRMISAMILGSKHTTCCSSTDRFFRLCNELAQVLTEVVYSNGGFYLKPGGTTSGDATTAYANSVFNIFQAVSANVN
KLLSVDSNVCHNLEVKQLQRKLYECCYRSTTVDDQFVVEYYGYLRKHFSMMILSDDGVVCYNNDYASLGYVADLNAFKAV
LYYQNNVFMSASKCWIEPDINKGPHEFCSQHTMQIVDKDGTYYLPYPDPSRILSAGVFVDDVVKTDAVVLLERYVSLAID
AYPLSKHENPEYKKVFYVLLDWVKHLYKTLNAGVLESFSVTLLEDSTAKFWDESFYANMYEKSAVLQSAGLCVVCGSQTV
LRCGDCLRRPMLCTKCAYDHVIGTTHKFILAITPYVCCASDCGVNDSTKLYLGGLSYWCHDHKPRLAFPLCSAGNVFGLY
KNSATGSPDVEDFNRIATSDWTDVSDYRLANDVKDSLRLFAAETIKAKEESVKSSYACATLHEVVGPKELLLKWEVGRPK
PPLNRNSVFTCYHITKNTKFQIGEFVFEKAEYDNDAVTYKTTATTKLVPGMVFVLTSHNVQPLRAPTIANQERYSTIHKL
HPAFNIPEAYSSLVPYYQLIGKQKITTIQGPPGSGKSHCVIGLGLYYPGARIVFTACSHAAVDSLCVKASTAYSNDKCSR
IIPQRARVECYDGFKSNNTSAQYLFSTVNALPECNADIVVVDEVSMCTNYDLSVINQRISYRHVVYVGDPQQLPAPRVMI
SRGTLEPKDYNVVTQRMCALKPDVFLHKCYRCPAEIVRTVSEMVYENQFIPVHPDSKQCFKIFCKGNVQVDNGSSINRRQ
LDVVRMFLAKNPRWSKAVFISPYNSQNYVASRMLGLQIQTVDSSQGSEYDYVIYTQTSDTAHACNVNRFNVAITRAKKGI
LCIMCDRSLFDVLKFFELKLSDLQANEGCGLFKDCSRGDDLLPPSHANTFMSLADNFKTDQDLAVQIGVNGPIKYEHVIS
FMGFRFDINIPNHHTLFCTRDFAMRNVRGWLGFDVEGAHVVGSNVGTNVPLQLGFSNGVDFVVRPEGCVVTESGDYIKPV
RARAPPGEQFAHLLPLLKRGQPWDVVRKRIVQMCSDYLANLSDILIFVLWAGGLELTTMRYFVKIGPSKSCDCGKVATCY
NSALHTYCCFKHALGCDYLYNPYCIDIQQWGYKGSLSLNHHEHCNVHRNEHVASGDAIMTRCLAIHDCFVKNVDWSITYP
FIGNEAVINKSGRIVQSHTMRSVLKLYNPKAIYDIGNPKGIRCAVTDAKWFCFDKNPTNSNVKTLEYDYITHGQFDGLCL
FWNCNVDMYPEFSVVCRFDTRCRSPLNLEGCNGGSLYVNNHAFHTPAFDKRAFAKLKPMPFFFYDDTECDKLQDSINYVP
LRASNCITKCNVGGAVCSKHCAMYHSYVNAYNTFTSAGFTIWVPTSFDTYNLWQTFSSNLQGLENIAFNVVKKGSFVGAE
GELPVAVVNDKVLVRDGTVDTLVFTNKTSLPTNVAFELYAKRKVGLTPPITILRNLGVVCTSKCVIWDYEAERPLTTFTK
DVCKYTDFEGDVCTLFDNSIVGSLERFSMTQNAVLMSLTAVKKLTGIKLTYGYLNGVPVNTHEDKPFTWYIYTRKNGKFE
DHPDGYFTQGRTTADFSPRSDMEKDFLSMDMGLFINKYGLEDYGFEHVVYGDVSKTTLGGLHLLISQVRLACMGVLKIDE
FVSSNDSTLKSCTVTYADNPSSKMVCTYMDLLLDDFVSILKSLDLSVVSKVHEVMVDCKMWRWMLWCKDHKLQTFYPQLQ
ASEWKCGYSMPSIYKIQRMCLEPCNLYNYGAGIKLPDGIMFNVVKYTQLCQYLNSTTMCVPHHMRVLHLGAGSDKGVAPG
TAVLRRWLPLDAIIVDNDSVDYVSDADYSVTGDCSTLYLSDKFDLVISDMYDGKIKSCDGENVSKEGFFPYINGVITEKL
ALGGTVAIKVTEFSWNKKLYELIQKFEYWTMFCTSVNTSSSEAFLIGVHYLGDFASGAVIDGNTMHANYIFWRNSTIMTM
SYNSVLDLSKFNCKHKATVVINLKDSSISDVVLGLLKNGKLLVRNNDAICGFSNHLVNVNK.

>USA/IL/2014/20697-P45 Spike protein (SEQ ID NO:41)
MKSLNYFWLFLPVLSTLSLPQDVTRCQSTINFRRFFSKFNVQAPAVVVLGGYLPSMNSSSWYCGTGLETASGVHGIFLSY
IDAGQGFEIGISQEPFDPSGYQLYLHKATNGNHNAIARLRICQFPDNKTLGPTVNDVTTGRNCLFNKAIPAYMQDGKNIV
VGITWDNDRVTVFADKIYHFYLKNDWSRVATRCYNKRSCAMQYVYTPTYYMLNVTSAGEDGIYYEPCTANCSGYAANVFA
TDSNGHIPEGFSFNNWFLLSNDSTLLHGKVVSNQPLLVNCLLAIPKIYGLGQFFSFNQTMDGVCNGAAAQRAPEALRFNI
NDTSVILAEGSIVLHTALGTNLSFACSNSSDPHLATFAIPLGATQVPYYCFLKVDTYNSTVYKFLAVLPPTVREIVITKY
GDVYVNGFGYLHLGLLDAVTINFTGHGTDDDVSGFWTIASTNFVDALIEVQGTAIQRILYCDDPVSQLKCSQVAFDLDDG
FYPISSRNLLSHEQPISFVTLPSFNDHSFVNITVSASFGGHSGANLIASDTTINGFSSFCVDTRQFTISLFYNVTNSYGY
VSKSQDSNCPFTLQSVNDYLSFSKFCVSTSLLASACTIDLFGYPEFGSGVKFTSLYFQFTKGELITGTPKPLEGVTDVSS
MTLDVCTKYTIYGFKGEGIITLTNSSFLAGVYYTSDSGQLLAFKNVTSGAVYSVTPCSFSEQAAYVDDDIVGVISSLSSS
TFNSTRELPGFFYHSNDGSNCTEPVLVYSNIGVCKSGSIGYVPSQSGQVKIAPTVTGNISIPTNFSMSIRTEYLQLYNTP
VSVDCATYVCNGNSRCKQLLTQYTAACKTIESALQLSARLESVEVNSMLTISEEALQLATISSFNGDGYNFTNVLGVSVY
DPARGRVVQKRSFIEDLLFNKVVTNGLGTVDEDYKRCSNGRSVADLVCAQYYSGVMVLPGVVDAEKLHMYSASLIGGMAL
GGFTSAAALPFSYAVQARLNYLALQTDVLQRNQQLLAESFNSAIGNITSAFESVKEAISQTSKGLNTVAHALTKVQEVVN
SQGAALTQLTVQLQHNFQAISSSIDDIYSRLDILSADVQVDRLITGRLSALNAFVAQTLTKYTEVQASRKLAQQKVNECV
KSQSQRYGFCGGDGEHIFSLVQAAPQGLLFLHTVLVPSDFVDVIAIAGLCVNDEIALTLREPGLVLFTHELQNHTATEYF
VSSRRMFEPRKPTVSDFVQIESCVDTYVNLTRDQLPDVIPDYIDVNKTLDEILASLPNRTGPSLPLDVFNAIYLNLTGEI
ADLEQRSESLRNTTEELQSLIYNINNTLVDLEWLNRVETYIKWPWWVWLIIFIVLIFVVSLLVFCCISTGCCGCCGCCCA
CFSGCCRGPRLQPYEVFEKVHVQ.

>USA/IL/2014/20697-P45 ORF3 protein (Truncated due to deletion/frameshift) (SEQ ID NO:42)
MFLGLFQ.

>USA/IL/2014/20697-P45 Envelope protein (SEQ ID NO:43)
MLQLVNDNGLVVNVILWLFVLFFLLIISITFVQLVNLCFTCHRLCNSAVYTPIGRLYRVYKFYMQIDPLPSTVIDV.

>USA/IL/2014/20697-P45 Membrane protein (SEQ ID NO:44)
MSNGSIPVDEVIQHLRNWNFTWNIILTILLVVLQYGHYKYSAFLYGVKMAILWILWPLVLALSLFDAWASFQVNWVFFAF
SILMACITLMLWIMYFVNSIRLWRRTHSWWSFNPETDALLTTSVMGRQVCIPVLGAPTGVTLTLLSGTLLVEGYKVATGV
QVSQLPNFVTVAKATTTIVYGRIGRSVNASSGTGWAFYVRSKHGDYSAVSNPSSVLTDSEKVLHLV.

>USA/IL/2014/20697-P45 Nucleocapsid protein (SEQ ID NO:45)
MASVSFQDRGRKRVPLSLYAPLRVTNDKPLSKVLANNAVPTNKGNKDQQIGYWTEQIRWRMRRGERIEQPSNWHFYYLGT
GPHADLRYRTRTEGVFWVAKEGAKTEPTNLGVRKASEKPIIPNFSQQLPSVVEIVEPNTPPTSRANSRSRSRGNGNNRSR

Fig. 27C

SPSNNRGNNQSRGNSQNRGNNQGRGASQNRGGNNNNNNKSRNQSKNRNQSNDRGGVTSRDDLVAAVKDALKSLGIGENPD
KLKQQQKPKQERSDSSGKNTPKKNKSRATSKERDLKDIPEWRRIPKGENSVAACFGPRGGFKNFGDAEFVEKGVDASGYA
QIASLAPNVAALLFGGNVAVRELADSYEITYNYKMTVPKSDPNVELLVSQVDAFKTGNAKPQRKKEKKNKRETTQQLNEE
AIYDDVGVPSDVTHANLEWDTAVDGGDTAVEIINEIFDTGN.

Fig. 34A

Table 2. (continued) Nucleotide and amino acid changes of PEDV isolate IL20697/2014 during serial passages in cell culture

| Position in protein | Amino acid at[b] | | | | | | | | | | | | | | |
|---|---|---|---|---|---|---|---|---|---|---|---|---|---|---|---|
| | P3 | P5 | P7 | P18 | P30 | P38 | P45 | P60 | P3R1 | P5R1 | P7R1 | P8R1 | P18 R1-89X8th Zoetis | P18R1-94F6a Zoetis | P18R1-97F6a Zoetis |
| 8 | Y | Y | Y | Y | Y | Y | * | | Y | Y | Y | Y | Y | Y | Y |
| 138-144 | YYDGK SI | YYDGK SI | YYDGK SI | YYDGK SI | YYDGK SI | | | | YYDGKSI | LIAMPL* | LIAMPL* | LIAMPL* | LIAMPL* | LIAMPL* | LIAMPL* |
| 174-189 | RGRQE ADLQLL LRTVEL | RGRQE ADLQLL RITVEL | QEALCLF ATSNCW HY* | QEALCLF ATSNCW HY* | QEALCLF ATSNCW HY* | QEALCLF ATSNCW HY* | | | RGRQLA DLQLRT VEL | RGRQLA DLQLRT VEL | | | | | |
| 62 | S | S | S | S | S | S | F | F | S | S | S | S | S | S | S |
| 5 | S | S | S | S | S | S | S | A | S | S | S | S | S | S | S |
| 183 | A | A | A | A | A | A | I | A | V | V | V | V | V | V | V |
| 27 | D | D | D | D | D | H | D | D | H | H | H | H | H | H | H |

Fig. 34B

PORCINE EPIDEMIC DIARRHEA VIRUS STRAINS AND IMMUNOGENIC COMPOSITIONS THEREFROM

CROSS-REFERENCED TO RELATED APPLICATIONS

This application is a national stage of PCT application PCT/US2016/019846 filed on Feb. 26, 2016, which in turn claims priority under 35 U.S.C § 119 to Provisional Patent Application Ser. No. 62/121,955 filed Feb. 27, 2015, Provisional Patent Application Ser. No. 62/209,119 filed Aug. 24, 2015, Provisional Patent Application Ser. No. 62/250,961 filed Nov. 4, 2015 and Provisional Patent Application Ser. No. 62/276,022 filed Jan. 7, 2016 herein incorporated by reference in their entirety.

THE NAMES OF THE PARTIES TO A JOINT RESEARCH AGREEMENT

The claimed invention was made as a result of activities undertaken within the scope of a joint research agreement between Zoetis Services LLC and Iowa State University Research Foundation.

FIELD OF THE INVENTION

The present invention is directed to novel immunogenic compositions that protect swine from disease caused by porcine epidemic diarrhea virus (PEDV).

BACKGROUND OF THE INVENTION

Porcine epidemic diarrhea (PED) is highly contagious and is characterized by dehydration, diarrhea, and high mortality in swine, particularly young piglets. The causative agent, porcine epidemic diarrhea virus (PEDV), is a single stranded, positive sense RNA virus belonging to the *Alphacoronavirus* genus of the family Coronaviridae. PEDV has a total genome size of approximately 28 kb and contains 7 open reading frames. Symptoms of PEDV infection are often similar to those caused by transmissible gastroenteritis virus (TGEV) and porcine deltacoronavirus (PDCoV), both of which are also members of the Coronaviridae, It should be noted that cross protection between PEDV and TGEV is not generally observed, the overall viral nucleotide sequences being at most about 60% similar.

PED was likely first observed in Europe circa 1970, and the causative virus was subsequently characterized (see for example M. Pensaert et al. Arch. Virol, v. 58, pp 243-247, 1978 and D. Chasey et al., Res. Vet Sci, v. 25, pp 255-256, 1978). PEDV was not identified in North America until 2013, at which point widespread outbreaks commenced, and severe economic losses to the swine industry resulted. The virus appeared in multiple, widely distributed sow herds within days, and it has spread to at least 32 states. Producers can expect losses of up to 100% in naïve neonatal piglets. Present recommendations for management of infection include implementation of strict biosecurity and/or intentional exposure of the whole herd to PEDV to accomplish immunity.

PEDV caused widespread epidemics in several European countries during the 1970s and 1980s; but since the 1990s PED has become rare in Europe with occasional outbreak. This classical PEDV strain subsequently was spread to Asian countries such as Japan, China, South Korea, etc. Since 2010, severe PED epizootic outbreaks have been reported in China and the PEDV recovered from these outbreaks were genetically different from the classical PEDV strains. The initial PED outbreaks in U.S. swine had similar clinical presentations to those observed in China. Sequence analyses revealed that the original U.S. PEDVs (hereafter designated as U.S. PEDV prototype strain) are most genetically similar to some PEDVs circulating in China in 2011-2102. In January 2014, a PEDV variant strain, which has insertions and deletions (INDEL) in the spike gene compared to the U.S. PEDV prototype strains, was identified in the U.S. swine population. This variant strain was designated as U.S. PEDV S-INDEL-variant strain. After the PED outbreak in the U.S., detection of U.S. prototype-like PEDV has been reported in Canada, Mexico, Taiwan, South Korea, and Japan; detection of U.S. S-INDEL-variant-like PEDV has been reported in South Korea, Japan, Germany, Belgium, France, and Portugal. Currently, PEDV remains as a significant threat to the global swine industry.

PEDV generally grows poorly in culture, and there is a need to identify both particular strains that are appropriate for the culturing of sufficient virus for commercial vaccine preparation. Additionally, there is a need to develop vaccines that provide effective cross protection against known isolates of PEDV, and which are expected to provide effective cross protection against evolving PEDV strains worldwide.

SUMMARY OF THE INVENTION

The present invention encompasses immunogenic compositions comprising variant PEDV strains passaged from prototype strain and from indel strains. The U.S. PEDV S-INDEL-variant strains are genetically different from the U.S. PEDV prototype-like strains, including characteristic insertions and deletions in the spike protein S1 domain region, particularly the first 1170 bases thereof. The insertions and deletions include 3 deletions (a 1-nt deletion at position 167, an 11-nt deletion at position 176, and a 3-nt deletion at position 416), a 6-nt insertion between positions 474 and 475, and several other mutations mainly located in the first 1,170 nucleotides of the S1 region. The U.S. PEDV S-INDEL-variant strains are less virulent than the U.S. PEDV prototype strains and may be used, in one embodiment or whole virus, as attenuated live vaccines. Pigs infected with live attenuated serially passaged S-INDEL-variant strains of the invention do not cause disease when administered to piglets and, importantly, exhibited cross protection against challenge with either the virulent prototype PEDV strains or the S-INDEL-variant strains.

Thus, the invention comprises an immunogenic composition, suitable to be used as a vaccine, which comprises a S-INDEL-variant PEDV strain of the invention, preferably live and attenuated, or an immunogenic fragment thereof, one or more adjuvants, and optionally one or more excipients, in an amount effective to elicit production of neutralizing antibodies in swine. The adjuvant preferably provides an oil-in-water emulsion with additional components. The immunogenic compositions of the invention protect swine from infection by PEDV, and are effective in single doses, in two-dose programs, or in vaccination programs involving multiple doses, which may be spread apart by at least a week, and optionally at greater intervals of time, such as one to several months. It should be noted that depending on the level of epidemic threat in a particular swine population, the vaccine dose program of one, two, or multiple doses may be repeated, from time to time, as a precautionary measure. Additionally, it should be noted that vaccinating a mother sow during pregnancy will provide protection to a young piglet, via maternal transfer of antibodies and T-cells in colostrum and milk, although such protection may need to be followed up with additional vaccination doses to the piglet. Vaccination of all swine, including piglets and adults is contemplated.

It has surprisingly been found that the U.S. PEDV S-IN-DEL-variant strain of the invention provides cross reactivity/protection against other PEDV strains and it is expected that protection will be conferred against European strains generally, and more particularly against the recently emerging isolates in Europe that had very high genetic similarity (>99%) to the U.S. S-INDEL-variant strains at the whole genome sequence level. Accordingly, the vaccinating compositions of the present invention are useful to protect swine from disease or challenge by European strains of PEDV generally, including recent isolates.

The present invention includes novel nucleotide and amino acid sequences of PEDV, including novel genotypes thereof, all of which are useful in the preparation of vaccines for treating and preventing diseases in swine and other animals. Vaccines provided according to the practice of the invention are effective against multiple swine PEDV genotypes and isolates. Diagnostic and therapeutic polyclonal and monoclonal antibodies are also a feature of the present invention, as are infectious clones useful in the propagation of the virus and in the preparation of vaccines. Of particular importance, there are disclosed vaccines that comprise, as antigen, a whole virus (live or attenuated) or an single antigenic protein of a PEDV open reading frame, most particularly from the first 2.2 kb of the spike gene, more particularly the S1 domain, and also fragments of the full length sequence encoding the PEDV proteins. The invention also provides the full length genomic sequences of PEDV strains at different passages in cell culture that can replicate efficiently in host animals and tissue culture.

The present invention provides a method of treating or preventing a disease or disorder in an animal caused by infection with PEDV, including disease states that are directly caused by PEDV, and disease states contributed to or potentiated by PEDV. Disease states in swine that may be potentiated by PEDV, and which may also be treated or prevented according to the practice of the invention, include those caused by or associated with Transmissible Gastroenteritis virus, PHEV, and PRCV.

The present invention also includes the option to administer a combination vaccine, that is, a bivalent or multivalent combination of antigens, which may include live, modified live, or inactivated antigens against the non-PEDV pathogen, with appropriate choice of adjuvant.

Based in part upon the unique PEDV sequences as disclosed herein, the present invention also provides a diagnostic kit for differentiating between porcine animals vaccinated with the above described PEDV vaccines and porcine animals infected with field strains of PEDV.

Representative embodiments of the invention include an isolated polynucleotide sequence that includes a genomic polynucleotide which encodes variant PEDV proteins which are attenuated and may be used as an immunogenic composition. This can include whole genome sequences selected from the group consisting of:

(a) SEQ ID NOS 8-16, and 35-39 or an immunogenic fragment thereof that encodes the PEDV virus variants;

(b) the complement of any sequence in (a);

(c) a polynucleotide that hybridizes with a sequence of (a) or (b) under stringent conditions defined as hybridizing to filter bound DNA in 0.5M NaHPO4, 7% SDS, 1 mM EDTA at 65° C., and washing in 0.1×SSC/0.1% SDS at 68° C.

(d) a polynucleotide that is at least 70% identical to the polynucleotide of (a) or (b);

(e) a polynucleotide that is at least 80% identical to the polynucleotide of (a) or (b);

(f) a polynucleotide that is at least 90% identical to the polynucleotide of (a) or (b); and (g) a polynucleotide that is at least 95% identical to the polynucleotide of (a) or (b)

Preferably in combination with a second heterologous sequence.

The invention further provides RNA and DNA molecules, their complements, fragments and vectors and plasmids for the expression of any such RNA or DNA polynucleotides, and for PEDV virus that is expressed from such nucleotide sequences, wherein said virus is live, or fully or partially attenuated.

The invention also provides a vaccine that comprises a polynucleotide sequence as aforementioned, and corresponding nucleotide sequences that may function as infectious clones.

The invention also includes nucleic acid ORFs which encode variant proteins from PEDV as reflected in Table 1 herewith. Table 1 variations are described with reference to PEDV USA/IL20697/2014 passage 5.

TABLE 1

Nucleotide and amino acid changes of PEDV isolate IL20697/2014 during serial passages in cell culture

| Virus | Genome region or ORF (nucleotide position)[a] | Encoded protein | Position in whole genome | P3 | P5 | P7 | P18 | P30 | P38 | P45 | P60 | P3R1 | P5R1 | P7R1 | P8R1 | P18R-1 89G8b Zoetis | P18R-1 94F6a Zoetis | P18R-1 92P6a Zoetis |
|---|---|---|---|---|---|---|---|---|---|---|---|---|---|---|---|---|---|---|
| PEDV USA/ IL20697/2014 | 5'UTR (1-292) | None | 424 | C | C | C | C | C | C | C | C | T | T | T | T | T | T | T |
| | ORF1a (293-12646); ORF1a/1b (293-12616), (12616-20637) | pp1a; pp1ab | 781 | G | T | T | T | T | T | T | T | TG | G | G | G | G | G | G |
| | | | 1944 | T | T | T | T | T | T | T | T | T | T | T | T | T | T | T |
| | | | 2083 | T | T | T | T | T | T | C | C | T | T | T | T | C | C | C |
| | | | 3610 | T | C | C | C | T | C | C | C | T | T | T | T | T | T | T |
| | | | 4400 | T | T | T | T | T | T | T | T | T | T | T | T | T | T | T |
| | | | 5064 | A | A | A | A | A | C | C | C | A | A | A | A | A | A | A |
| | | | 6367 | T | T | T | T | T | T | T | T | T | T | T | T | T | T | T |
| | | | 7435 | A | A | A | A | A | G | G | G | A | A | A | A | A | A | A |
| | | | 11080 | C | C | C | C | C | C | C | C | C | C | C | C | C | C | C |
| | | | 12391 | C | C | C | C | C | C | C | C | C | C | C | C | C | C | C |
| | | | 13387 | T | T | T | T | T | T | T | T | T | T | T | T | T | T | T |
| | | | 13992 | C | C | C | C | C | C | C | C | G | G | G | G | G | G | G |
| | | | 14691 | C | C | C | C | C | C | T | C | T | T | T | T | T | T | T |
| | | | 15550-15551 | GT | GT | GT | GT | GT | GT | TC | TC | GT | GT | GT | GT | GT | GT | GT |
| | | | 18704 | A | A | A | A | A | G | G | G | A | A | A | A | A | A | A |
| | S (20634-24785) | Spike | 20717 | C | C | C | C | C | T | T | T | C | C | C | C | C | C | C |
| | | | 20775 | G | G | G | G | G | G | G | T | T | T | T | T | T | T | T |
| | | | 21083 | T | A | A | A | A | A | A | A | A | A | A | A | A | A | A |
| | | | 21667 | C | C | C | C | C | C | C | C | T | T | T | T | T | T | T |
| | | | 22232 | G | G | A | G | G | G | G | G | G | G | G | G | G | G | G |
| | | | 22530 | C | G | C | C | C | C | C | C | C | C | C | C | C | C | C |
| | | | 22919 | C | A | C | A | C | T | T | T | C | C | C | C | C | C | C |
| | | | 23283 | A | A | A | A | T | T | T | T | A | A | A | A | A | A | A |
| | | | 23509 | T | T | T | T | T | T | T | A | T | T | T | T | T | T | T |
| | | | 23550 | T | T | T | T | T | T | T | A | T | T | T | T | T | T | T |
| | | | 23658 | T | T | T | T | T | A | A | A | T | T | T | T | T | T | T |
| | | | 24307 | C | C | C | C | C | C | C | T | C | C | C | C | C | C | C |
| | | | 24448 | TC | T | T | T | T | T | T | T | C | C | C | C | C | C | C |
| | ORFS (24785-2549)[d] | Hypothetical protein 3 | 24808-24823 | CACGA TTGAC ACAGT | CACGA TTGAC ACAGT | CACGA TTGAC ACAGT | CACGA TTGAC ACAGT | CACGA TTGAC ACAGT | CACGA TTGAC ACAGT | — | — | CACGA TTGAC ACAGT | CACGA TTGAC ACAGT | CACGA TTGAC ACAGT | CACGA TTGAC ACAGT | CACGA TTGAC ACAGT | CACGA TTGAC ACAGT | CACGA TTGAC ACAGT |
| | | | 25197-25201 | ATTAT T | ATTAT T | ATTAT T | ATTAT C | ATTAT C | AT--- T | AT--- T | AT--- T | ATTAT --- T | T ---- T | T ---- T | T ---- T | T ---- T | T ---- T | T ---- T |
| | | | 25304 | C | C | C | — | — | — | — | — | C | C | C | C | C | C | C |
| | | | 25359 | CGTGG GCGGC AAGAA GCTGA | CGTGG GCGGC AAGAA GCTGA | — | — | — | — | — | — | CGTGG GCGGC AAGAA GCTGA | CGTGG GCGGC AAGAA GCTGA | CGTGG GCGGC AAGAA GCTGA | CGTGG GCGGC AAGAA GCTGA | CGTGG GCGGC AAGAA GCTGA | CGTGG GCGGC AAGAA GCTGA | CGTGG GCGGC AAGAA GCTGA |

TABLE 1-continued

Nucleotide and amino acid changes of PEDV isolate IL20697/2014 during serial passages in cell culture

| Genome region or ORF (nucleotide position)[a] | Encoded protein | Position in whole genome | Nucleotide in[a]: P3 | P5 | P7 | P18 | P30 | P38 | P45 | P60 | P3R1 | P5R1 | P7R1 | P8R1 | P18R-1 89G8b Zoetis | P18R-1 94F6a Zoetis | 92P6a Zoetis |
|---|---|---|---|---|---|---|---|---|---|---|---|---|---|---|---|---|---|
| | | | CCTAC AGCTG TTGCG AACTG TTGAG CTTCTT GATGG | CCTAC AGCTG TTGCG AACTG TTGAG CTTCTT GATGG | — — — — — — — | — — — — — — — | — — — — — — — | — — — — — — — | — — — — — — — | — — — — — — — | CCTAC AGCTG TTGCG AACTG TTGAG CTTCTT GATGG | CCTAC AGCTG TTGCG AACTG TTGAG CTTCTT GATGG | CCTAC AGCTG TTGCG AACTG TTGAG CTTCTT GATGG | CCTAC AGCTG TTGCG AACTG TTGAG CTTCTT GATGG | CCTAC AGCTG TTGCG AACTG TTGAG CTTCTT GATGG | CCTAC AGCTG TTGCG AACTG TTGAG CTTCTT GATGG | CCTAC AGCTG TTGCG AACTG TTGAG CTTCTT GATGG |
| E(25440-25670) | Envelope | 25624 | C | C | C | C | C | C | T | T | C | C | C | C | C | C | C |
| M(25678-26358) | Membrane | 25690 | T | T | T | T | T | T | T | T | T | T | T | T | T | T | T |
| | | 26224 | G | G | G | G | G | G | A | G | G | G | G | G | G | G | G |
| N(26370-27695) | Nucleo-capsid | 26448 | G | G | G | G | G | G | G | G | C | C | C | C | C | C | C |
| | | 26864 | C | T | T | T | T | C | T | T | C | C | C | C | C | C | C |
| 3'UTR (26370-27695) | None | | | | | | | | | | | | | | | | |

[a]Nucleotides are numbered according to the PEDV USA/IL20697/2014 P3 sequences.
[b]Only nonsynonymous mutations are shown and sile mutations are not shown. Amino acids of replicase proteins are numbered according to their locations in the replicase polyprotein pp1ab.
[c], stop codon.
[d]compared to the P3, P5, P18 and P30 viruses as well as PrR1, P5R1, P8R1 viruses, the P45 and P60 viruses had 16-nucleotide deletion at the nucleotide positions 24,803-24,823, resulting in early stop of ORF3 translation of the P45 and P60 viruses. Basically the deduced P45 and P60 ORF3 proteins are only 7 amino acid long.
Compared to the P5 virus, the P7, P8, P18 viruses had 4-nucleotide deleta (ATTA) at the nucleotide positions 25,197-25,200, resulting in early stop of ORF3 translations of the P7, P8, and P18 viruses. Basically the deduced P7, P8 and P18 ORF3 proteins are 143 aa long.
Compared to the P3, P5, P7, P18 and P30 virus, the P45 and P60 viruses had 3-nucleotide deletion (TAT) at the nucleotide positions 25,199-25,201.
Compared to the P3R1 virus, the P5R1 virus had 3-nucleotide deletion (TAT) at the nucleotide postions 25,199-25,201.
Compared to the P3R1 virus, the P5R1, P7R1, and P18R1 viruses had 4-nucleotide deletion (ATTA) at the nucleotide positions 25,197-25,200.
Compared to the P3 and P5 viruses as well at P3R1, P5R1, P7R1, and P18R1 viruses, the P7, P18, P30, P45 and P60 virus had 56-nucleotide deletion at the nucleotide positions 25,304-25,35

The invention further provides nucleic acid sequences and resultant protein variants that have amino acid substitutions and which reduce virulence, cause attenuation and allow the compositions to be used safely as immunogenic compositions and as vaccines.

Amino acid sequences and variant proteins are shown in Table 2 herewith again, amino acid references are made with respect to passage 5 of PEDV/USA/IL20697/2014.

In a further preferred embodiment, and taking advantage of the substantial polypeptide sequence information disclosed herein, there are further provided polypeptide vaccines wherein the antigen is defined by (a) the spike protein; or (b) an amino acid sequence that is at least 90 percent identical thereto; or (c) an arginine rich region thereof.

In a further embodiment the invention includes vaccine compositions comprising a a live attenuated variant strain porcine epidemic diarrhea virus (PEDV), and a carrier, wherein said composition is capable of protecting swine from challenge by both variant and prototype strains of PEDV and preventing or treating one or more of symptoms associated with PEDV infection, and wherein achievement of protection is determined by an endpoint selected from the group consisting of prevention or control of any of the PEDV infection symptoms of dehydration, fever, diarrhea, vomiting, poor lactational performance, poor reproduction performance, mortality, and prevention or control of weight loss or failure to gain weight, wherein said strain encodes proteins with a substitution of the following amino acids and their conservative variants and proteins with the specific substitutions and 99% homology to the remainder of the sequences: acid substitutions include the following or their conservative variants:

A) Passage P18R1 F6a
polyprotein 1a/1b (SEQ ID NO: 46): P at position 551 (P immediately after DEDAT);
spike protein (SEQ ID NO:47): P at position 1009 (P immediately after IGNIT), H at position 973 (H immediately after ALPFS), L at position 48 (L immediately after APAVV), V at position 345 (A immediately after TNLSF);
ORF 3 (SEQ ID NO: 48): deletion of I at position 144 (I immediately after YDGKS), deletion of 174-189 (immediately after LYLAI), LTANPL at position 138-143 (immediately after NGKAA), and,
nucleocapsid protein (SEQ ID NO: 51) H at position 27 (H immediately after LRVTN).

B) Passage P18R1 Gb8
Spike protein (SEQ ID NO:47): P at position 1009 (P immediately after IGNIT), H at position 973 (H immediately after ALPFS), L at position 48 (L immediately after APAVV), V at position 345(A immediately after TNLSF);
ORF 3 (SEQ ID NO: 48): deletion of I at position 144 (I immediately after YDGKS), deletion of 174-189 (immediately after LYLAI), LTANPL at position 138-143 (immediately after NGKAA), and,
nucleocapsid protein (SEQ ID NO: 51) H at position 27 (H immediately after LRVTN).

C) Passage P7
spike protein (SEQ ID NO:47): K at position 633 (K immediately after TPKPL);
ORF 3 (SEQ ID NO:48): deletion of L at position 189 (L immediately after TANPL).

D) Passage P18
spike protein (SEQ ID NO:47): K at position 633 (K immediately after TPKPL), R at position 884 (R immediately after VYDPA);
ORF 3 (SEQ ID NO:48): deletion of L at position 189 (L immediately after TANPL).

E) Passage P30
spike protein (SEQ ID NO:47): R at position 884 (R immediately after VYDPA), A at position 959 (A immediately after LIGGM);
ORF 3 (SEQ ID NO:48): deletion of L at position 189 (L immediately after TANPL).

F) Passage P38
spike protein (SEQ ID NO:47): L at position 48 (L immediately after APAVV), V at position 345 (immediately after TNLSF), R at position 884 (R immediately after VYDPA), A at position 959 (A immediately after LIGGM),
ORF 3 (SEQ ID NO:48): deletion of 138-144(immediately after NGKAA) deletion of L at 189 (L immediately after TANPL),
Nucleocapsid (SEQ ID NO:51) H at position 27 (H immediately after LRVTN).

G) Passage P45
polyprotein 1a/1b (SEQ ID NO:46): M at position 1591 (M immediately after VVKVS), S at position 5087 (S immediately after YLFST), S at position 6138 (S immediately after WQTFS);
spike protein (SEQ ID NO:47): R at position 884 (R immediately after VYDPA), A at position 959 (A immediately after LIGGM), D at position 1225 (D immediately after IESLV);
ORF 3 (SEQ ID NO:48): deletion of Y at position 8 (Y immediately after LGLFO), deletion of 138-144 (immediately after NGKAA), and deletion of 174 to 189 189 (immediately after LYLAI),
envelope protein (SEQ ID NO:49) F at position 62 (F immediately after YRVYK);
membrane protein I at position 183 (I immediately after IVYGG).

H) Passage P60
polyprotein 1a/1b (SEQ ID NO:46): M at position 1591 (M immediately after VVKVS), S at position 5087 (S immediately after YLFST), S at position 6138 (S immediately after WQTFS);
spike protein (SEQ ID NO:47): R at position 884 (immediately after VYDPA), A at position 959 (immediately after LIGGM), H at position 973 (H immediately after ALPFS), D at position 1225 (D immediately after IESLV);
ORF 3 (SEQ ID NO:48): deletion of Y at position 8 (Y immediately after LGLFO), deletion of 138-144 (immediately after NGKAA), and deletion of 174 to 189 (immediately after LYLAI),
envelope protein (SEQ ID NO:49) F at position 62 (F immediately after YRVYK);
membrane protein A at position 5 (A immediately after MSNG), I at position 183(I immediately after IVYGG).

I) Passage P3R1
spike protein (SEQ ID NO:47): L at position 48 (immediately after APAVV), V at position 345 (immediately after TNLSF); T at position 1272 (T immediately after DVFNA)
envelope protein (SEQ ID NO:49) S at position 62 (S immediately after YRVYK);
nucleocapsid protein (SEQ ID NO:51): H at position 27 (H immediately after LRVTN).

The invention further includes passages and amino acid substitution from passaging the prototype virus, deposited at Genbank® Accesssion KF650371 Passage 3. Variations in amino acids are reflected the following:

polyprotein 1a/1b (SEQ ID NO:52): V at 814, A at 1076, F at 1564, I at 1896, H at 2310 Y at 2600, F at 3247, V at 3473, or R at 3522;

spike protein (SEQ ID NO:54): N at 257, I at 326, F at 375, Y at 491, R at 881, R at 888 F at 1277, T at 1339, or L at 1358;

ORF 3 (SEQ ID NO:55) stop at 39 or later;

Envelope protein (SEQ ID NO:56) position I at 69;

membrane protein (SEQ ID NO: 57) position T at 208;

nucleocapsid protein (SEQ ID NO: 58) position L at 141, Q at 418, N at 424, or I at 439.

It is within the scope of the invention to make additional modifications in any PEDV passages described herein, wherein said modifications include introducing mutations of another passage (Prototype, INDEL lineage 1, or INDEL lineage 2 and combinations thereof) described herein using known methods according to one of skill in the art, for example, homologous recombination.

GenBank® is the recognized United States-NIH genetic sequence database, comprising an annotated collection of publicly available DNA sequences, and which further incorporates submissions from the European Molecular Biology Laboratory (EMBL) and the DNA DataBank of Japan (DDBJ), see Nucleic Acids Research, January 2013, v 41(D1) D36-42 for discussion.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

The following drawings form part of the specification and are included to further demonstrate certain embodiments or various aspects of the invention. In some instances, embodiments of the invention can be best understood by referring to the accompanying drawings in combination with the detailed description presented herein. The description and accompanying drawings may highlight a certain specific example, or a certain aspect of the invention. However, one skilled in the art will understand that portions of the example or aspect may be used in combination with other examples or aspects of the invention.

FIG. 2 shows phylogenetic trees based on the S1 portion sequences and the whole genome sequences. See the attachment.

FIG. 3A shows the S1 sequence of the strain of the invention (SEQ ID NO: 1). FIG. 3B shows the whole genome sequence of the S-INDEL-variant PEDV cell culture isolate 2014020697-P5 passage 5, lineage 1 (SEQ ID NO:8).

Figure 4B:
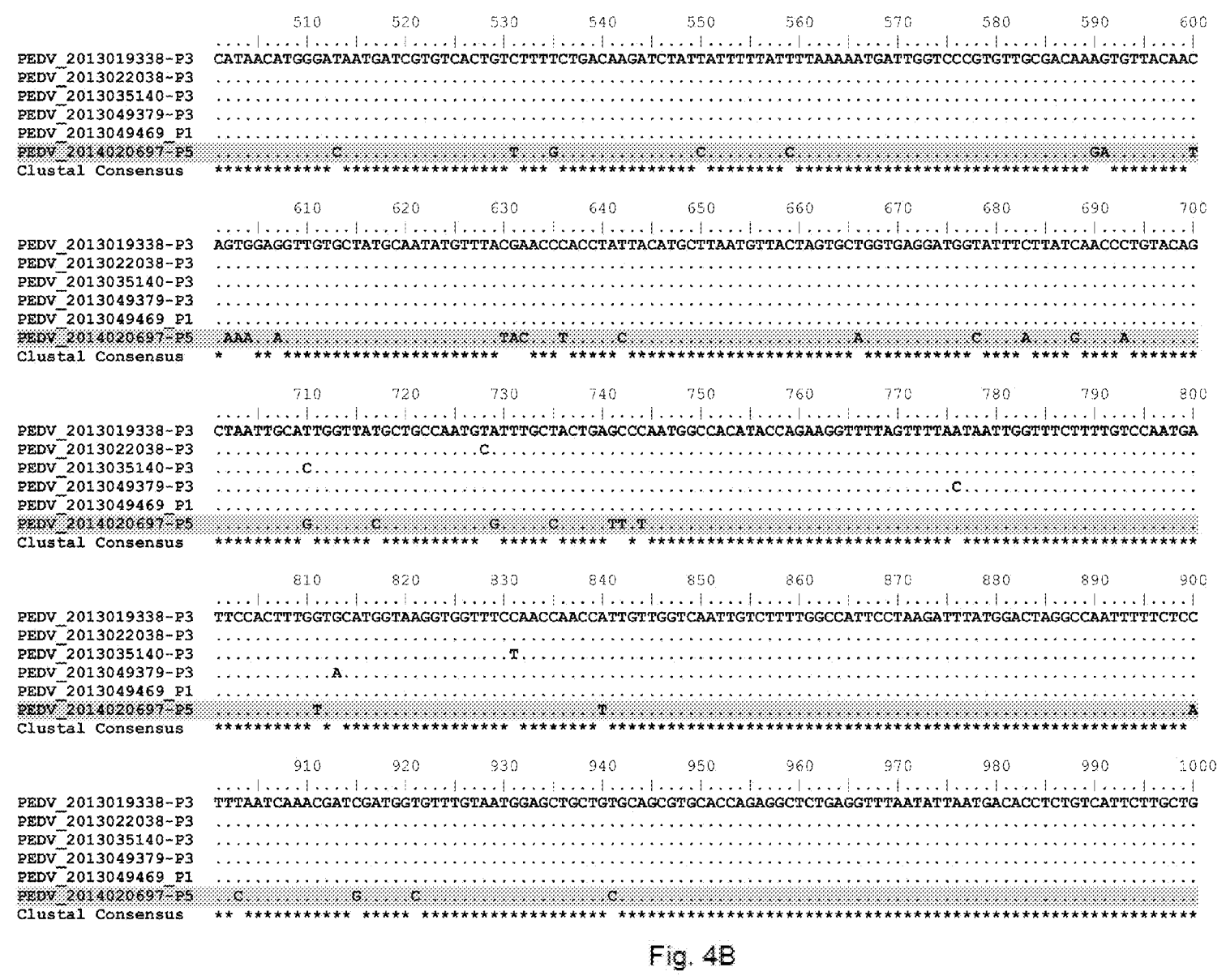
Figure 4E:
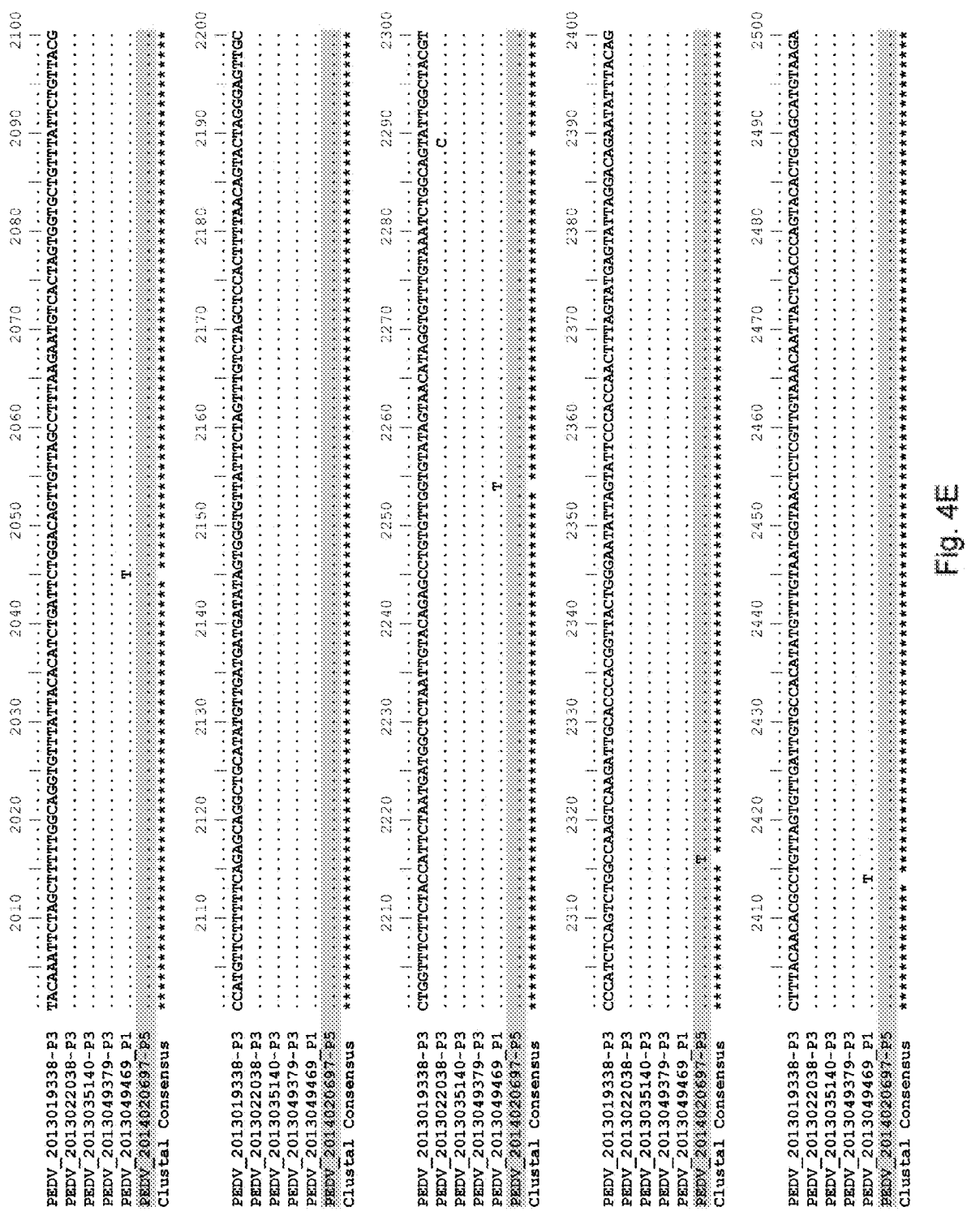
Figure 4I:
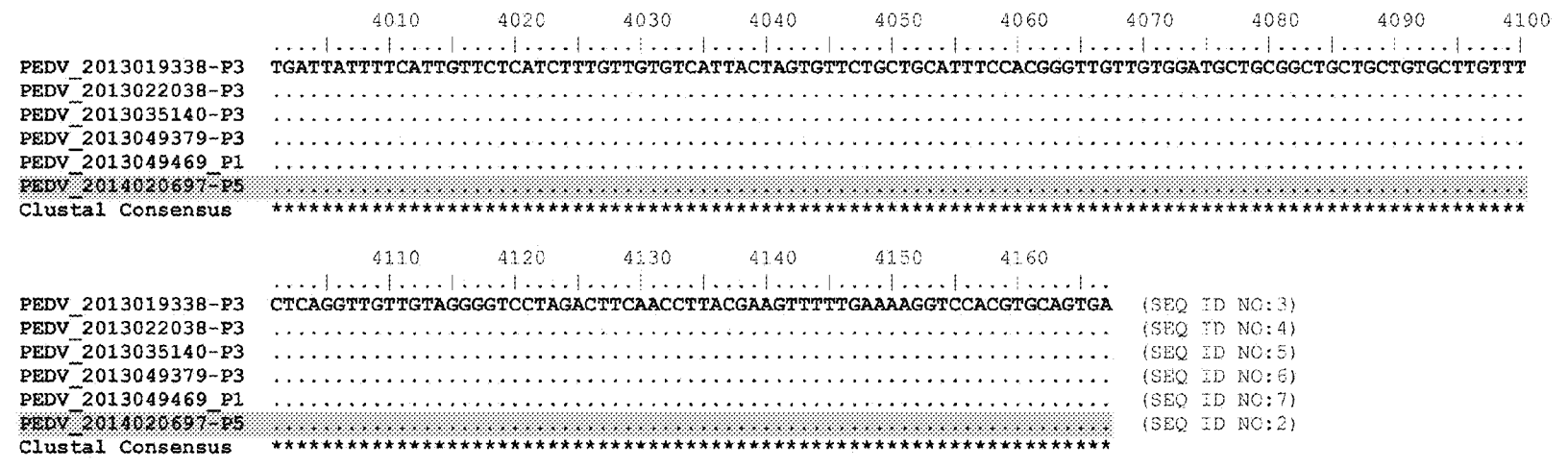

FIGS. 4A-4I are an alignment comparing the spike gene sequences of the PEDV US S-INDEL-variant isolate 2014020697-P5 passage 5, lineage 1 (SEQ ID NO:2) to the PEDV US prototype isolates 2013019338-P3 passage 3 (SEQ ID NO:3), 2013022038-P3 passage 3 (SEQ ID NO:4), 2013035140-P3 passage 3 (SEQ ID NO:5), 2013049379-P3 passage 3 (SEQ ID NO:6), and 2013049469-P1 passage 1 (SEQ ID NO:7), identical bases are indicated with dots.

FIGS. 6A-6D are the phylogenetic analysis of the full-length genome and S1 portion nucleotide sequences. Three U.S. prototype PEDV isolates obtained in this study (USA/NC35140/2013, USA/IA49379/2013 and USA/NC49469/2013) and two isolates previously isolated but evaluated in this study (U.S. PEDV prototype isolate USA/IN19338/2013 and U.S. S-INDEL-variant isolate USA/IL20697) are indicated with bullet points or triangle. Forty-five PEDV sequences selected from GenBank® were also included for analysis. The trees were constructed using the distance-based neighbor-joining method (6A and 6C) and the maximum likelihood method (FIG. 6B and FIG. 6D) of the software MEGA6. The U.S. prototype-like PEDVs are shown in blue color fonts with clade 1 and clade 2 indicated. The U.S. S-INDEL-variant-like PEDVs are shown in red color fonts.

FIG. 7A shows the average diarrhea scores over the course of 7 days post inoculation (DPI). FIG. 7B shows the average daily weight gain (ADG). Statistical analyses on ADG were performed among groups from (−1) to 3 DPI and from (−1) to 7 DPI, respectively. Virus shedding in rectal swabs are shown in FIG. 7C and in sera in FIG. 7D of inoculated pigs was determined by a quantitative PEDV N gene-based real-time RT-PCR. The virus titers (Log 10Genomic copies/ml) at each time point were mean virus titers of all available pigs (both PCR-positive and negative pigs) in each group. Standard error bars are shown in each figure. In FIG. 7D, viremia levels among the groups were statistically analyzed at 3 DPI and 7 DPI, respectively. Labels without the same letters indicate significant differences, for example A and B have significant difference but A and AB have no significant differences.

FIG. 8A-8B show the examination of gross lesions of inoculated pigs at 3 DPI and 7 DPI necropsies. Average scores of contents of small intestine, cecum and colon are shown in FIG. 8A. Average scores of lesions of small intestine, cecum and colon are shown in FIG. 8B. The scoring criteria were described in Materials and Methods Example 2. Statistical analyses were performed on various inoculated groups, but each time on one tissue type and on one time point. Labels without the same letters indicate significant differences.

Figure 1:
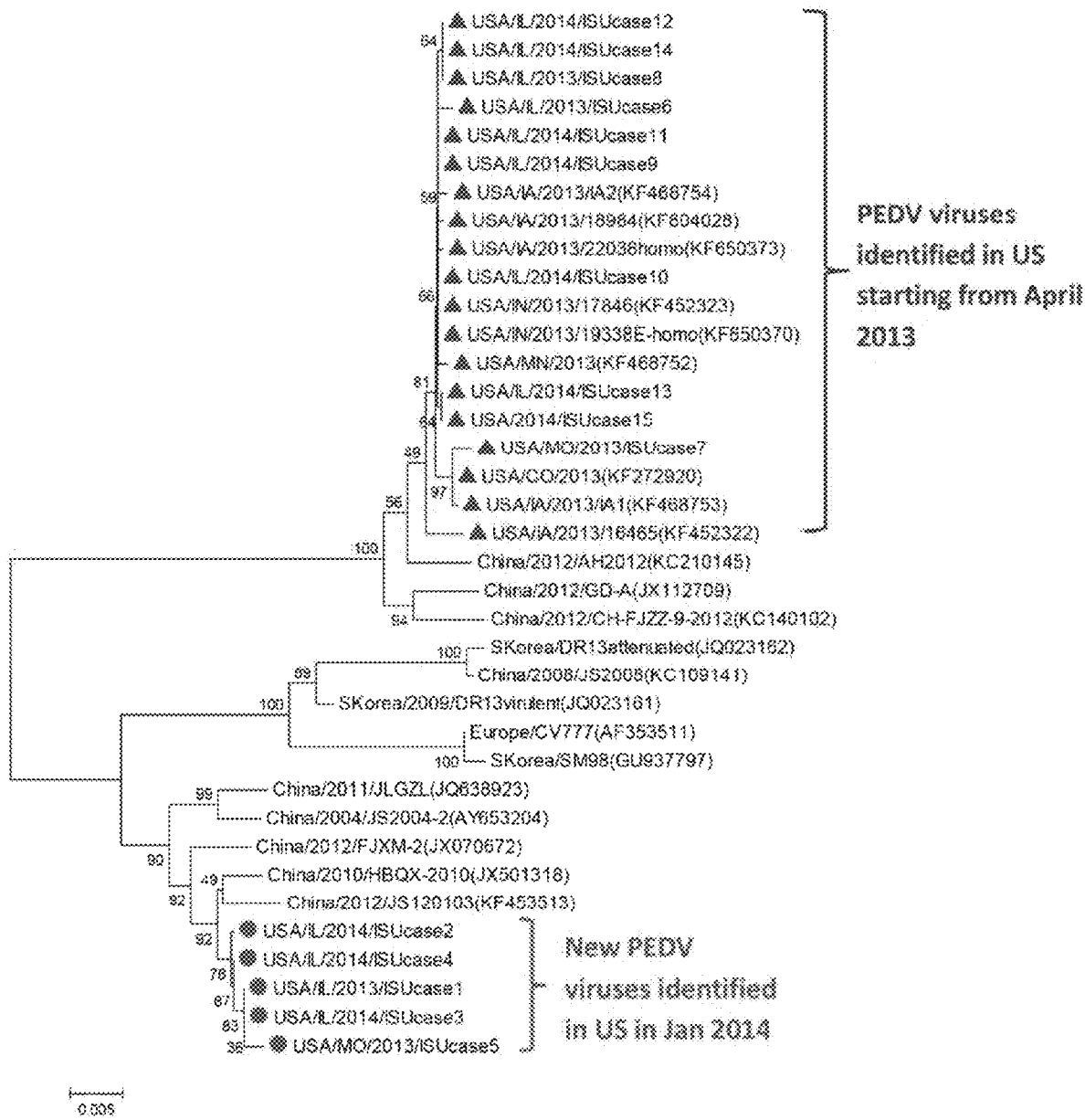
FIG. 1 shows a phylogenetic analysis of the PEDV S1 portion nucleotide sequences from clinical cases in January 2014 when our group first identified U.S. PEDV S-INDEL-variant strain. The tree was constructed using the distance-based neighbor-joining method of the software MEGA 5.2. Bootstrap analysis was carried out on 1,000 replicate data sets, and values are indicated adjacent to the branching points. The newly identified U.S. PEDV S-INDEL-variant strains (ISU cases 1-5) are indicated with solid circles that had sequences different from PEDV identified in US in 2013 (U.S. PEDV prototype strain) which are indicated with triangles.

Immunohistochemistry-stained tissue sections of ileum (FIG. 9F-9J), cecum (FIG. 9K-9O), and colon (FIG. 9P-9T) from different inoculation group. All images are in 100× magnification.

FIG. 10A-10D shows the mean villus height (µm), crypt depth (µm), villus/crypt ratio, and immunohistochemistry scores of pigs necropsied at 3 DPI. Statistical analyses were performed on various inoculated groups, but each time on one tissue type. Labels without the same letters indicate significant differences.

FIG. 11A-11D shows the mean villus height (µm), crypt depth (µm), villus/crypt ratio, and immunohistochemistry scores of pigs necropsied at 7 DPI. Statistical analyses were performed on various inoculated groups, but each time on one tissue type. Labels without the same letters indicate significant differences.

FIG. 12 is a schematic diagrams of PEDV genome organization and putative functions of viral proteins. The PEDV entire genome organization is depicted (top). The 5' leader, ORFs 1a and 1b encoding replicase polyproteins, spike (S), ORF3, envelope (E), membrane (M) and nucleocapsid (N) genes are shown, with the ribosomal frameshift site indicated. Predicted cleavage products (nsp1-nsp16) of the replicase polyproteins and putative functional domains are depicted (bottom). Nsp1 may possibly suppress the innate immune response and host protein synthesis. The exact function of nsp2 remains unclear. Nsp3 includes papain-like proteases (PL1pro and PL2pro, cleavage sites=white arrow) and adenosine diphosphate-ribose 1"-phosphatase (ADRP, X domain) activity. The PL2pro is also an interferon antagonist. Nsp5 is the main protease or 3C-like protease (3CLpro, cleavage site=black arrow). Nsp3, nsp4 and nsp6 contain transmembrane domains (TM) and function as membrane anchor proteins. Nsp7 and nsp8 form a hexadecameric complex with a central channel for binding to the double-stranded RNA and initiating RNA synthesis. Nsp9 is a single-stranded RNA-binding protein (RBP). Nsp10 is a co-factor (activator) of nsp14 and nsp16. The nsp14 has 3'-5' exonuclease (ExoN) at the N-terminal and 7-methyltransferase (7MT) at the C-terminal. The nsp16 acts as the 2'-O-methyltransferase (2'-O-MT). The interactions between nsp10, nsp14 and nsp16 plays a crucial role in replication fidelity and methylation of the virus. The nsp11 function is not fully understood yet. Nsp12 is the viral RNA-dependent RNA polymerase (RdRP). Nsp13 harbors a zinc-binding domain (ZBD) and viral helicase. Nsp13 also has NTPase and RNA 5' triphosphatase activity. Nsp15 contains a motif known as nidoviral uridylate-specific endoribonuclease (NendoU). The S protein functions as the virus attachment protein interacting with the cell receptor. Additionally, the S protein is postulated to harbor neutralization epitopes and is also associated with viral virulence/attenuation. The M protein and E protein play a pivotal role in viral assembly. The N protein binds to the viral genome RNA and packs into the nucleocapsid. The N protein has also been shown to antagonize interferon-n production. The accessory protein encoded by ORF3 may be associated with cell culture adaptation and may also have an influence on cell cycle and subcellular structure.

Figure 13:
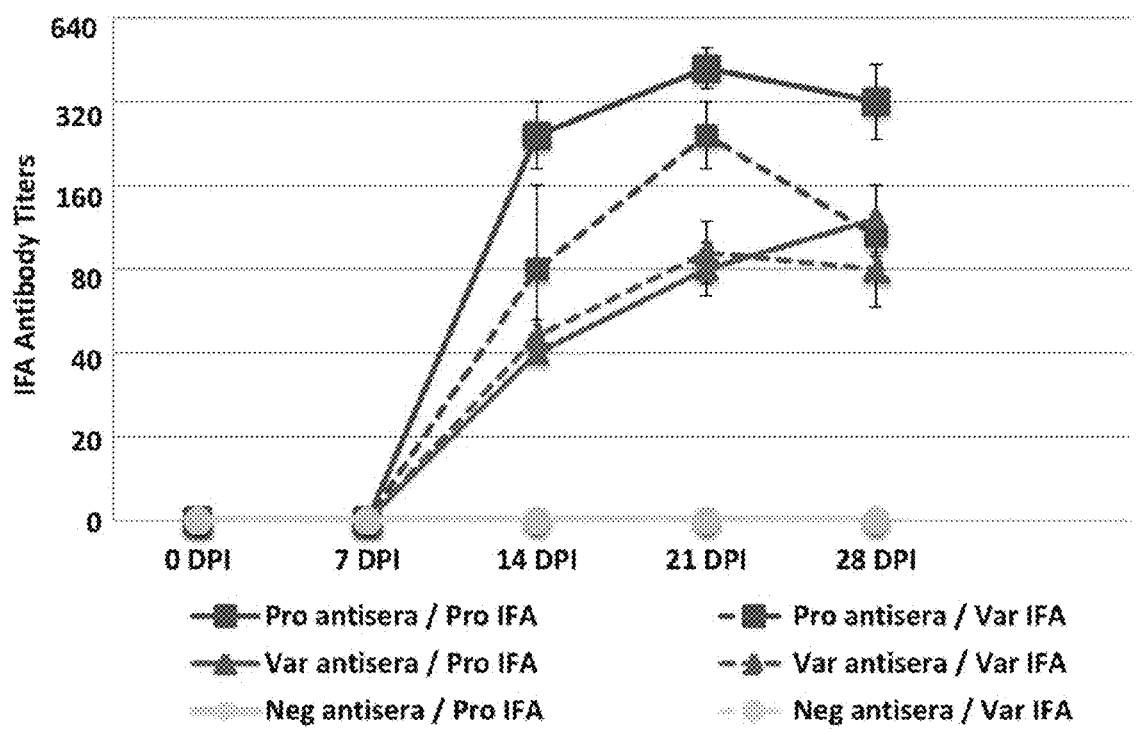
Figures 14A, 14B, 14C:
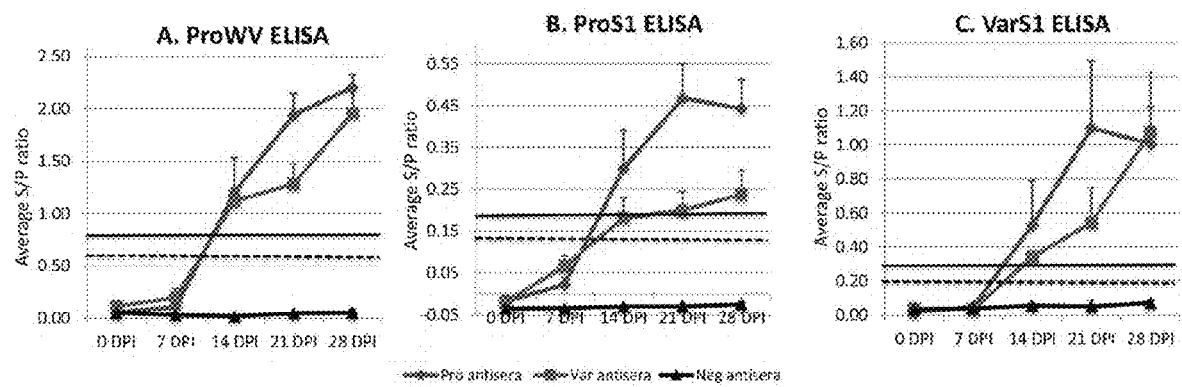

FIG. 13 is an image showing IFA antibody testing of antisera against the U.S. PEDV prototype and S-INDEL-variant strains. The average IFA antibody titers are shown at the top and the number of IFA antibody positive samples is shown at the bottom. Pro antisera: antisera collected from the U.S. PEDV prototype strain-inoculated pigs; Var antisera: antisera collected from the U.S. PEDV S-INDEL-variant strain-inoculated pigs; Neg antisera: antisera collected from negative control pigs; Pro IFA: the U.S. PEDV prototype strain-based IFA; Var IFA: the U.S. PEDV S-INDEL-variant strain-based IFA FIG. 14A-14C show testing of antisera against the U.S. PEDV prototype and S-INDEL-variant strains by ProWV ELISA (FIG. 14A), ProS1 ELISA (FIG. 14B) and VarS1 ELISA (FIG. 14C). For each assay, the solid black line indicates the S/P ratio above which the sample was positive; the dot black line indicates the S/P ratio below which the sample was negative; samples with S/P ratios between the solid and dot black line were suspect. ProWV ELISA: the U.S. PEDV prototype strain whole virus-based ELISA; ProS1 ELISA: the U.S. PEDV prototype strain S1-based ELISA; VarS1 ELISA: the U.S. PEDV S-INDEL-variant strain S1-based ELISA.

Figure 15:
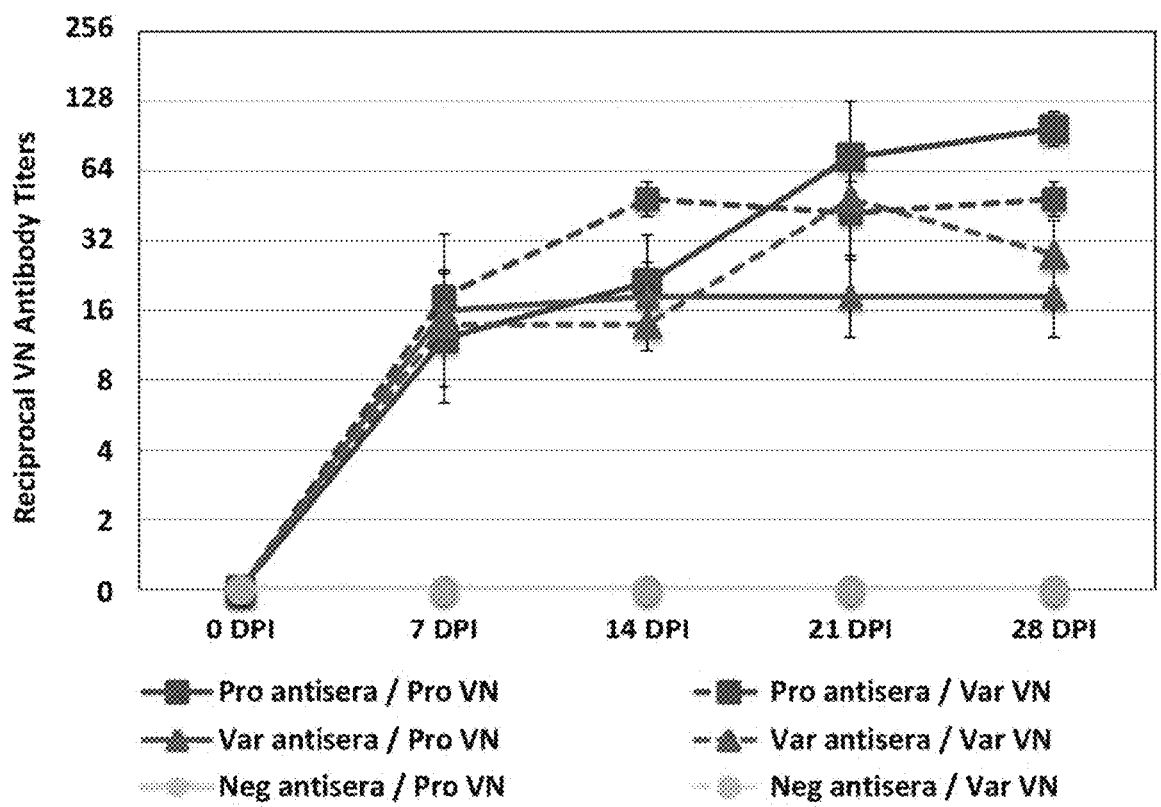

FIG. 15 shows virus neutralization antibody testing of antisera against the U.S. PEDV prototype and S-INDEL-variant strains. The average VN antibody titers are shown at the top and the number of VN antibody positive samples is shown at the bottom. Pro VN: the U.S. PEDV prototype strain-based VN; Var VN: the U.S. PEDV S-INDEL-variant strain-based VN.

Figure 16:
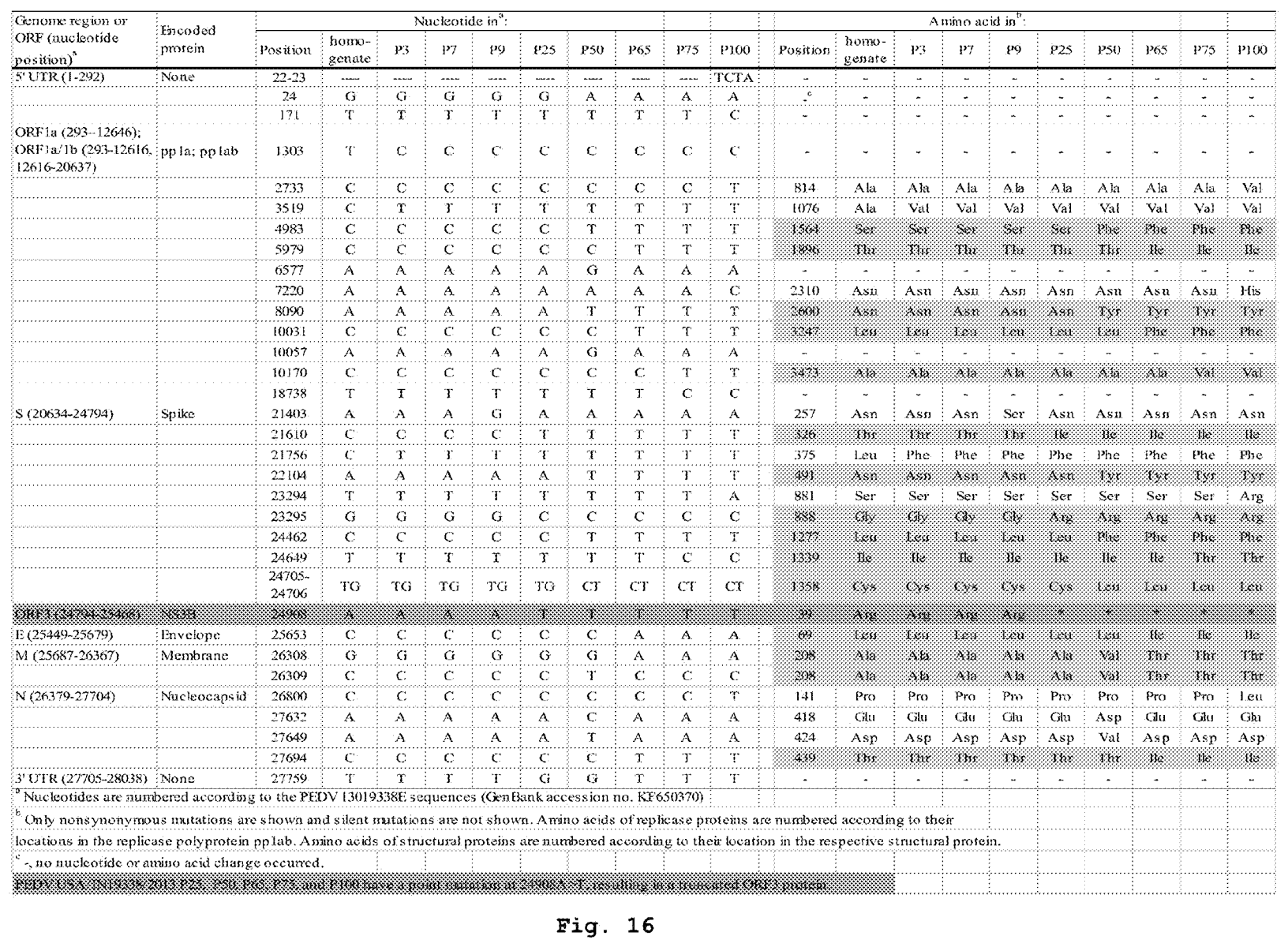

FIG. 16 show a table comparing the nucleotide and amino acid changes of U.S. prototype PEDV isolate USA/IN19338/2013 during serial passages in cell culture.

Figure 17:
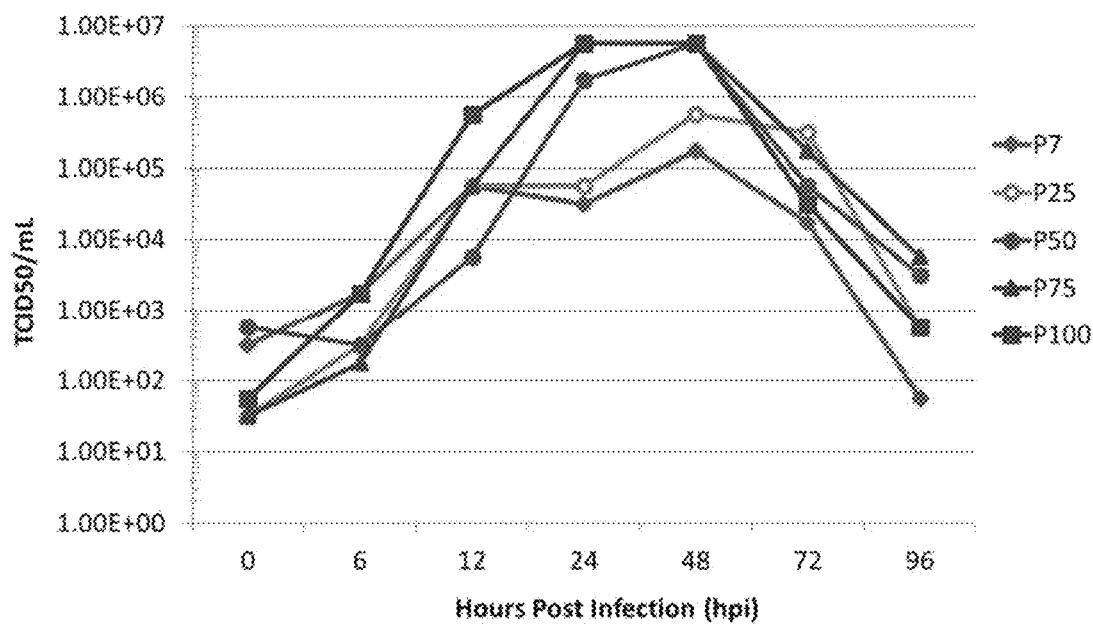

FIG. 17 shows the growth curve of the U.S. PEDV prototype isolate USA/IN19338/2013 P7, P25, P50, P75 and P100 in Vero cells.

Figure 18:
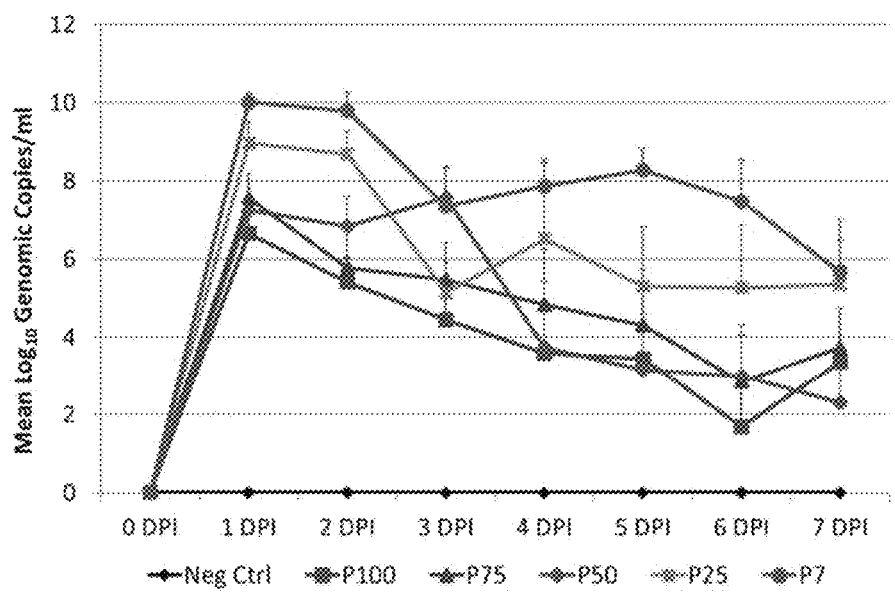

FIG. 18 is a graph showing virus shedding in rectal swabs of various inoculation groups during 0-7 days post inoculation (DPI). Different letters indicate significant differences.

Figure 19:
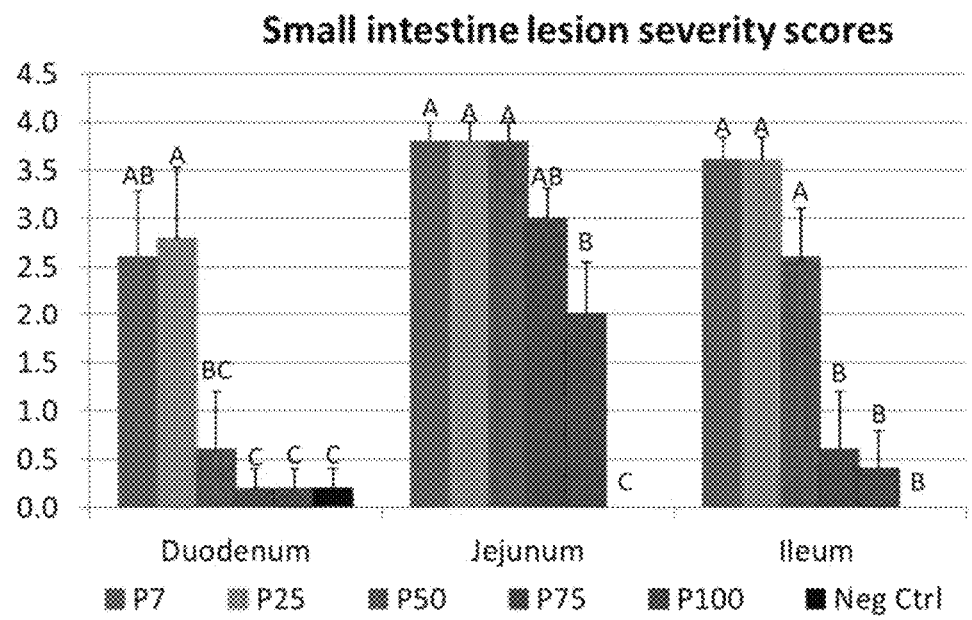

FIG. 19 shows small intestine microscopic lesion severity scores in various groups of piglets inoculated with the PEDV USA/IN19338/2013 P7, P25, P50, P75 and P100 at 3 days post inoculation. Labels without the same letters indicate significant differences, for example A and B have significant differences but A and AB have no significant differences.

Figure 20:
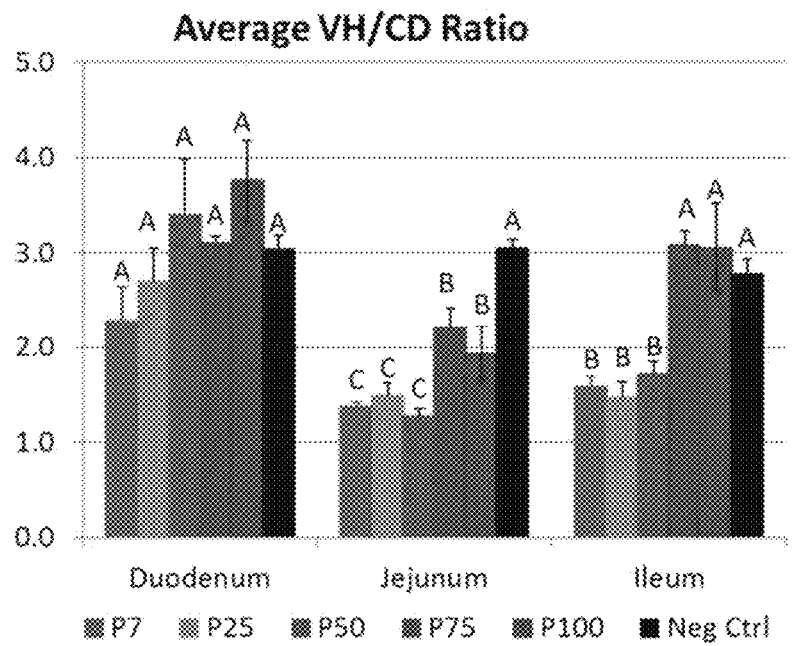

FIG. 20 shows the average villus-height-to-crypt-depth ratios of small intestines in various groups of piglets inoculated with the PEDV USA/IN19338/2013 P7, P25, P50, P75 and P100 at 3 days post inoculation. Different letters indicate significant differences.

Figure 21:
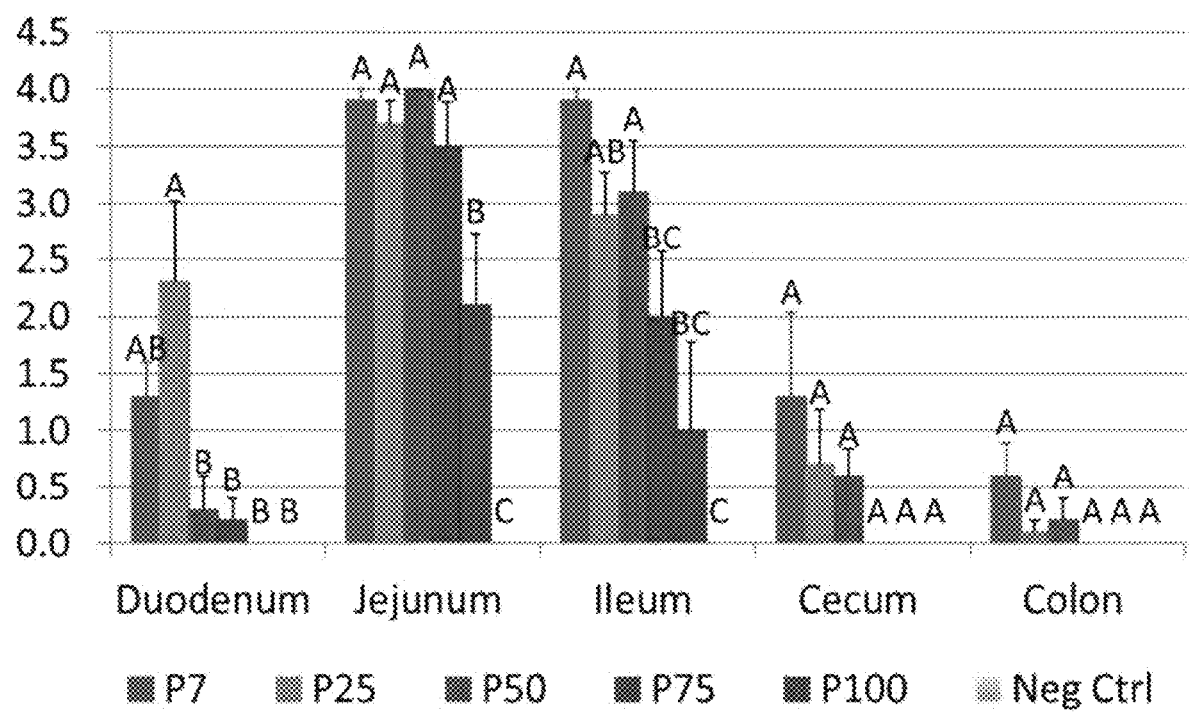
Figure 26K:
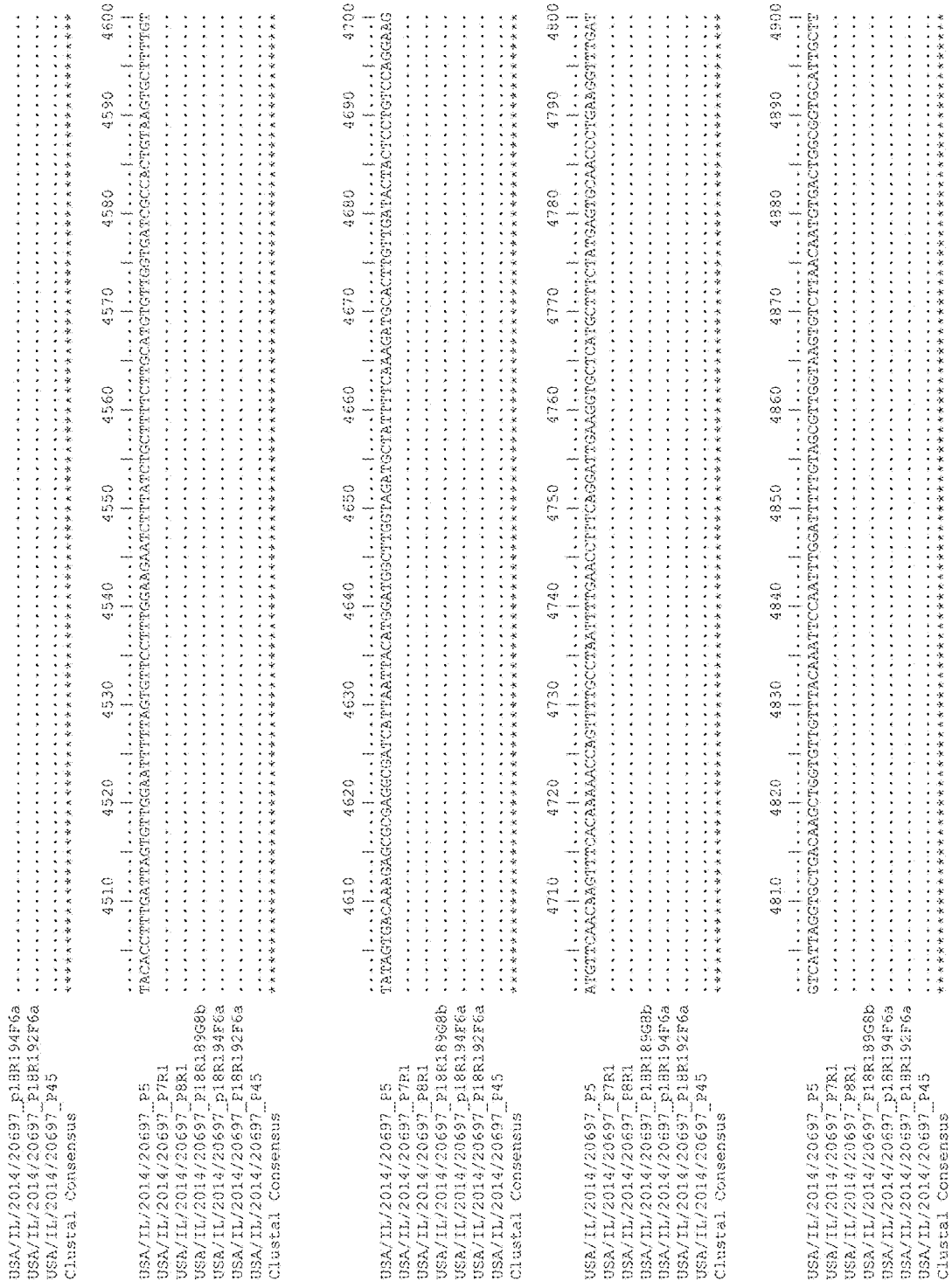

FIG. 21 shows the average immunohistochemistry scores in small intestines, ceca and colons in various groups of piglets inoculated with the PEDV USA/IN19338/2013 P7, P25, P50, P75 and P100 at 3 days post inoculation.

FIG. 22A-22C shows sequences according to exemplary embodiments of the invention. FIG. 22A shows the sequence of 2014020697-P8R1 passage 8, lineage 2 ORF1a/1b polyprotein (SEQ ID NO: 17); 2014020697-P8R1 passage 8, lineage 2 spike protein (SEQ ID NO: 18), 2014020697-P8R1 passage 8, lineage 2 ORF 3 protein (truncated) (SEQ ID NO: 19), 2014020697-P8R1 passage 8, lineage 2 envelope protein (SEQ ID NO: 20), 2014020697-P8R1 passage 8, lineage 2 membrane protein (SEQ ID NO: 21), and 2014020697-P8R1 passage 8, lineage 2 nucleocapsid protein (SEQ ID NO: 22). FIG. 22B shows the 2014020697-P18R1 passage 18, lineage 2 clone G8b ORF1a/1b polyprotein (SEQ ID NO: 23), 2014020697-P18R1 passage 18, lineage 2 clone G8b spike protein (SEQ ID NO: 24), 2014020697-P18R1 passage 18, lineage 2 clone G8b ORF3 protein (truncated) (SEQ ID NO: 25), 2014020697-P18R1 passage 18, lineage 2 clone G8b envelope protein (SEQ ID NO: 26), 2014020697-P18R1 passage 18, lineage 2 clone G8b membrane protein (SEQ ID NO: 27) and 2014020697-P18R1 passage 18, lineage 2 clone G8b nucleocapsid protein (SEQ ID NO: 28). FIG. 22C is 2014020697-P18R1 passage 18, lineage 2 clone F6a ORF1a/1b polyprotein (SEQ ID NO: 29); 2014020697-P18R1 passage 18, lineage 2 clone F6a spike protein (SEQ ID NO: 30), 2014020697-P18R1 passage 18, lineage 2 clone F6a ORF 3 protein (truncated) (SEQ ID NO: 31), 2014020697-P18R1 passage 18, lineage 2 clone F6a envelope protein (SEQ ID NO: 32), 2014020697-P18R1 passage 18, lineage 2 clone F6a membrane protein (SEQ ID NO: 33), and 2014020697-P18R1 passage 18, lineage 2 clone F6a nucleocapsid protein (SEQ ID NO: 34).

FIG. 23A-23C shows sequences according to exemplary embodiments the invention. FIG. 23A shows the genomic nucleotide sequence for 2014020697-P8R1 passage 8, lineage 2 (SEQ ID NO:35), FIG. 23B shows the nucleotide sequence for 2014020697-P18R1 passage 18, lineage 2 clone G8b complete genome (SEQ ID NO: 36); FIG. 23C shows 2014020697-P18R1 passage 18, lineage 2 clone F6a complete genome nucleotide sequence (SEQ ID NO: 37).

FIGS. 24A-24C are a chart showing the INDEL sequence comparison for various passages.

FIGS. 25A to 25H are the genomic nucleotide sequence of 2014020697-P45 passage 45, lineage 1 (SEQ ID NO:39).

Figure 26A:
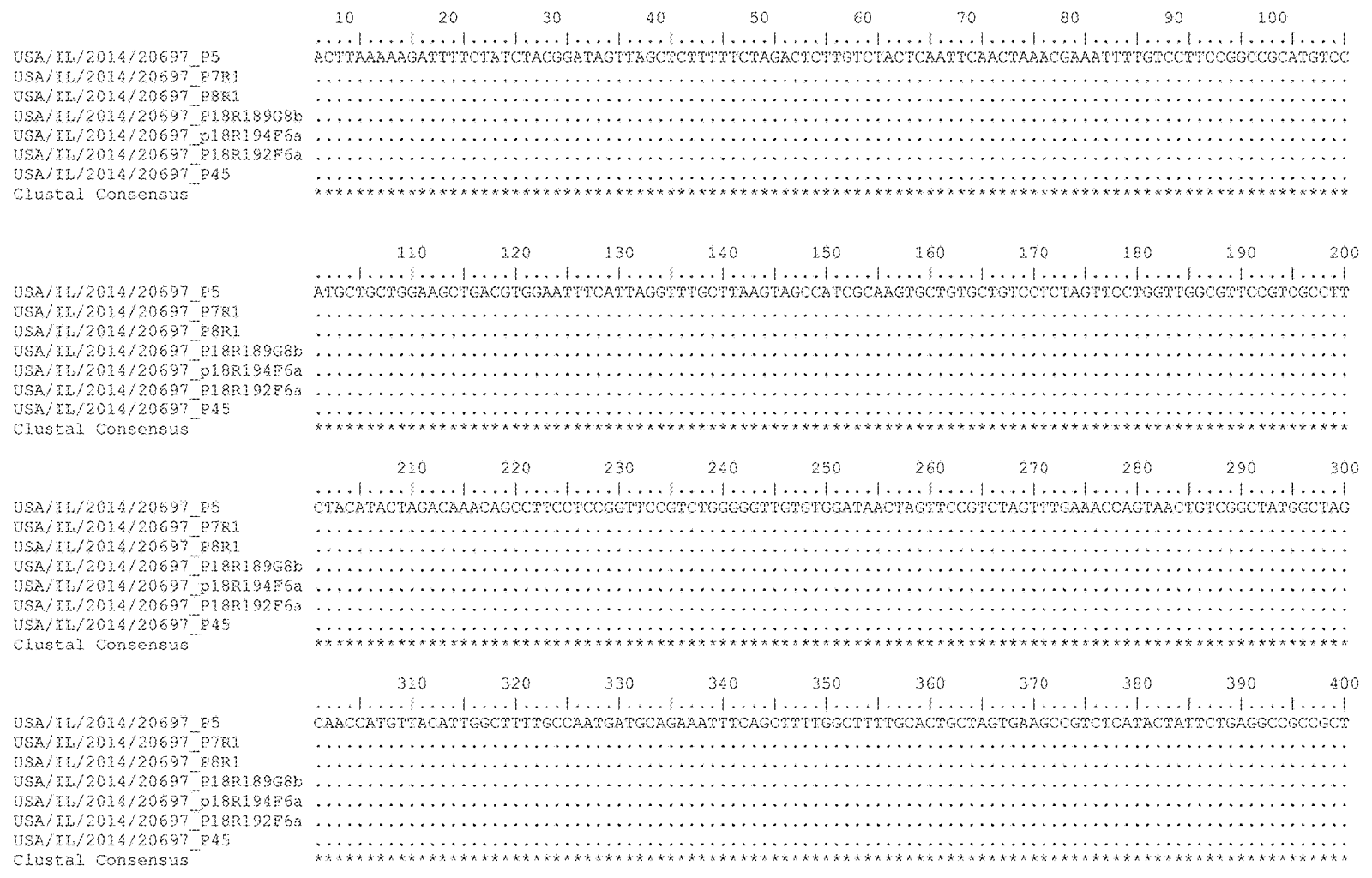
Figure 26B:
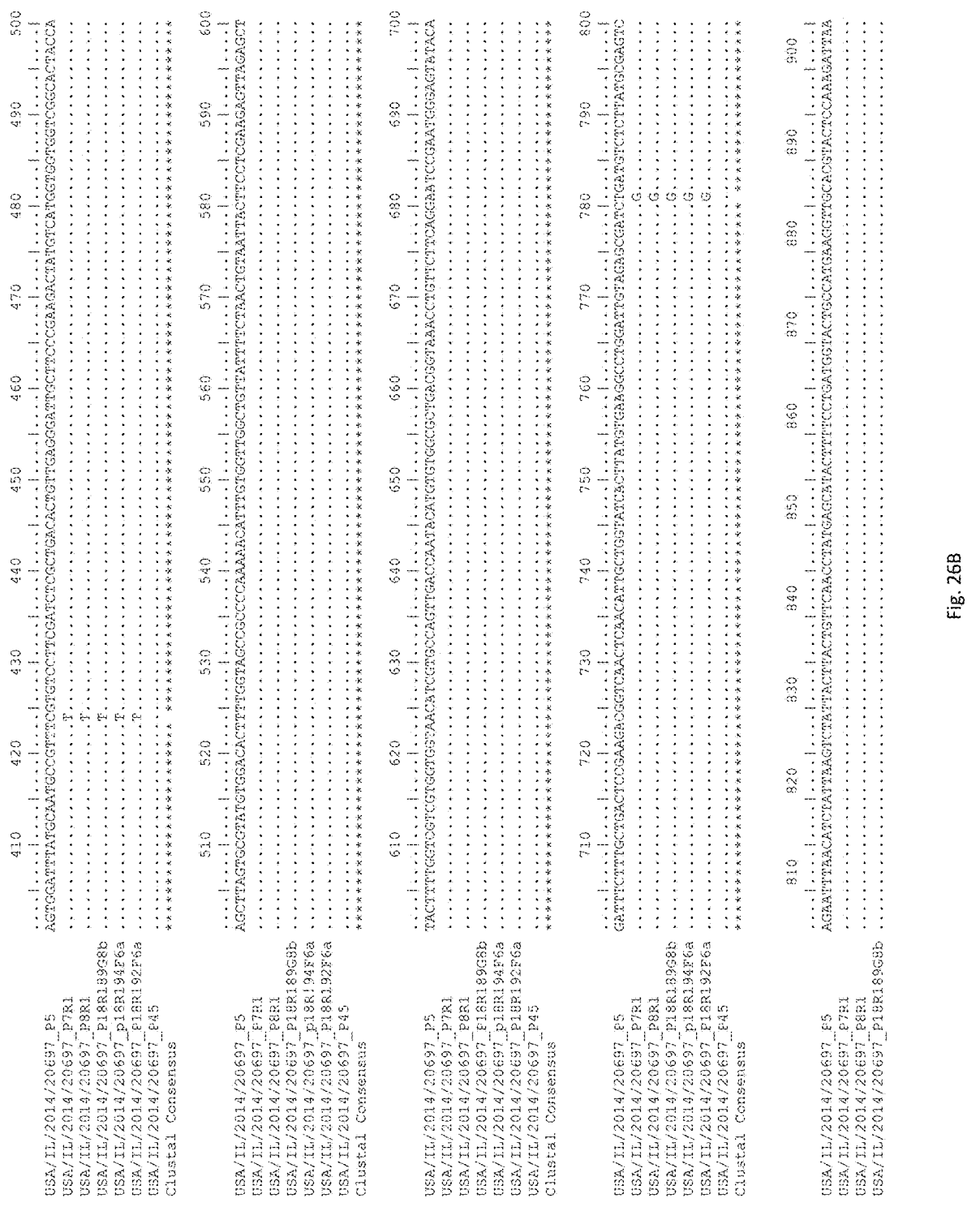
Figure 26C:
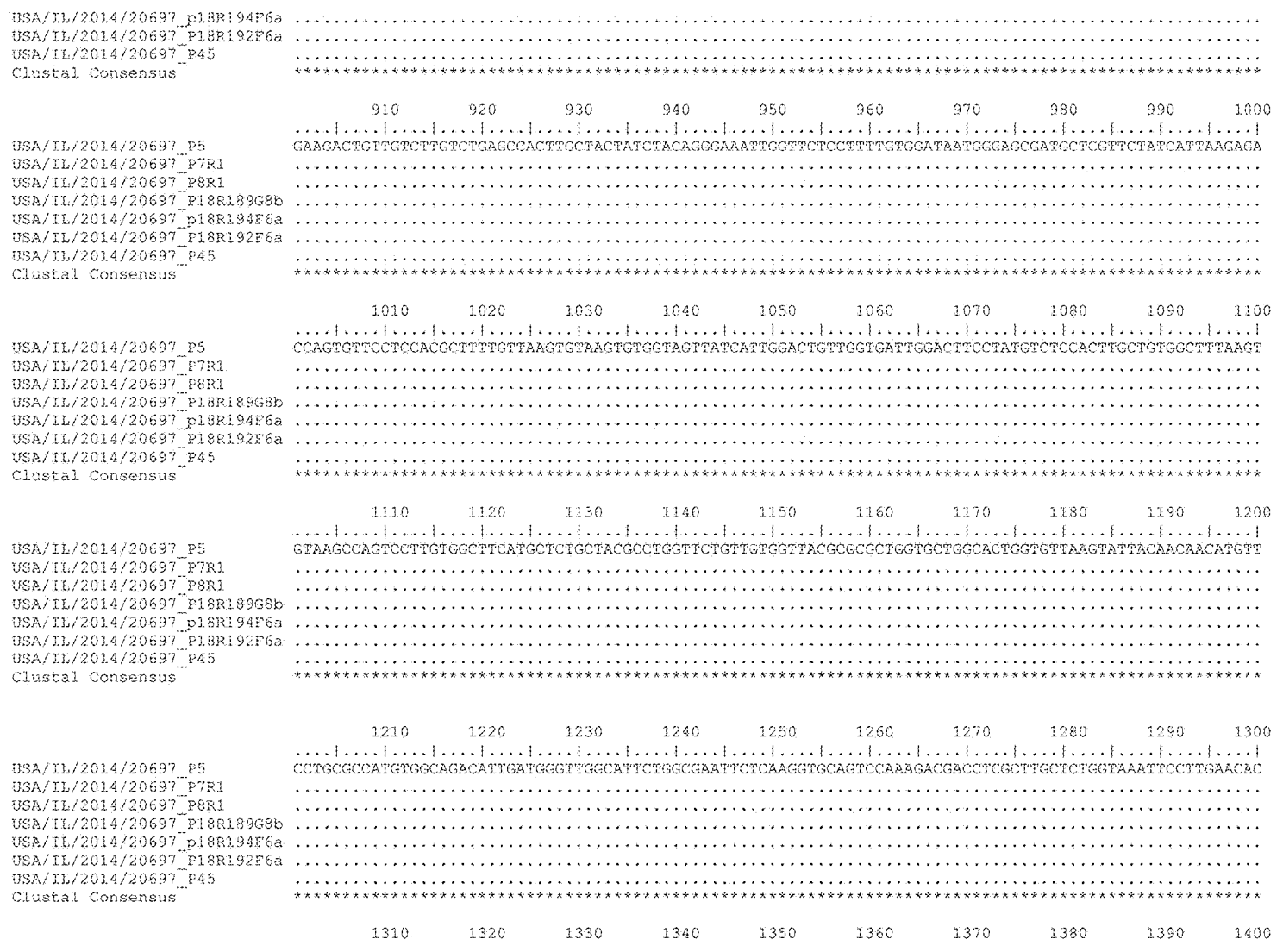
Figure 26D:
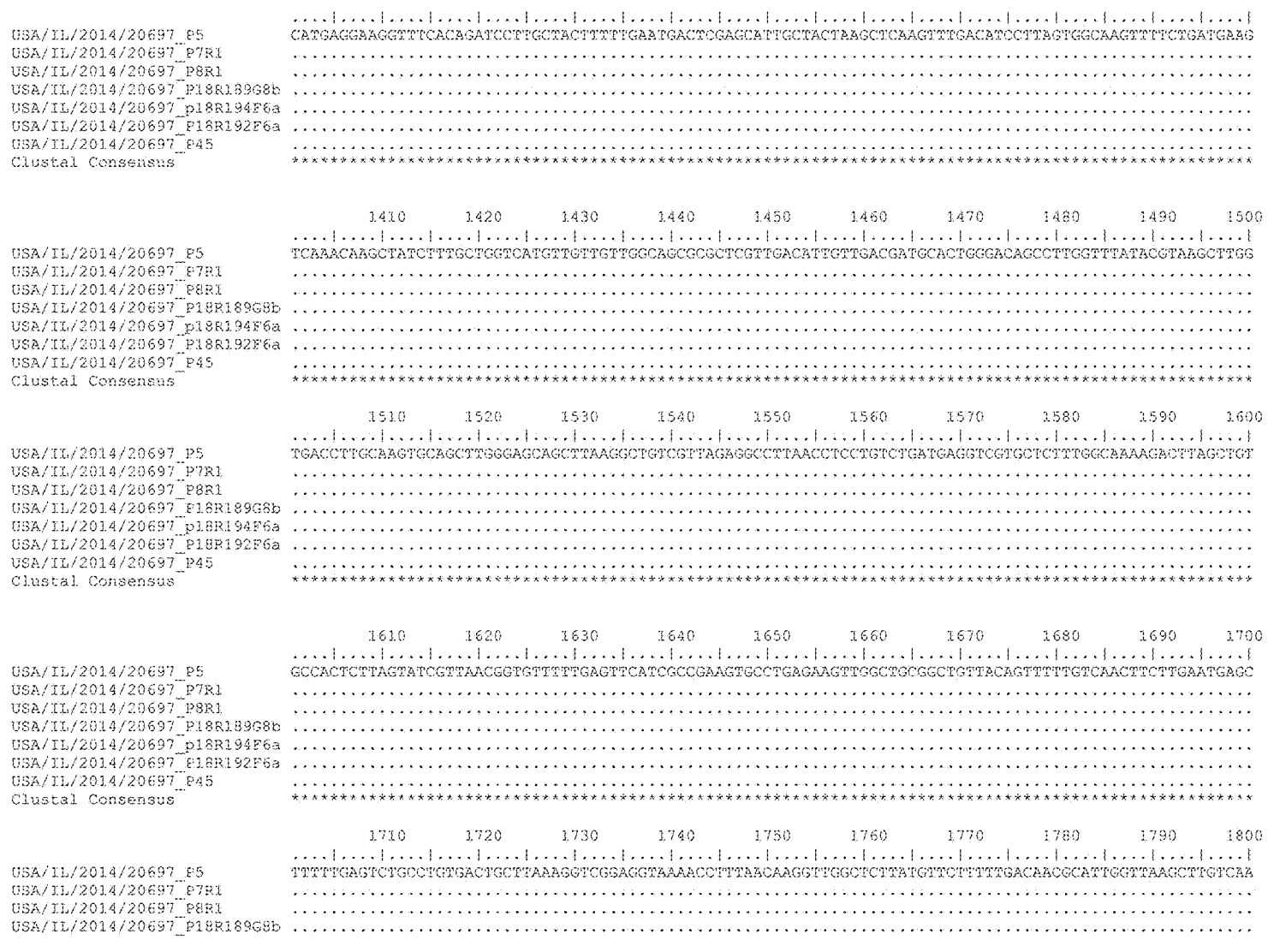
Figure 26E:
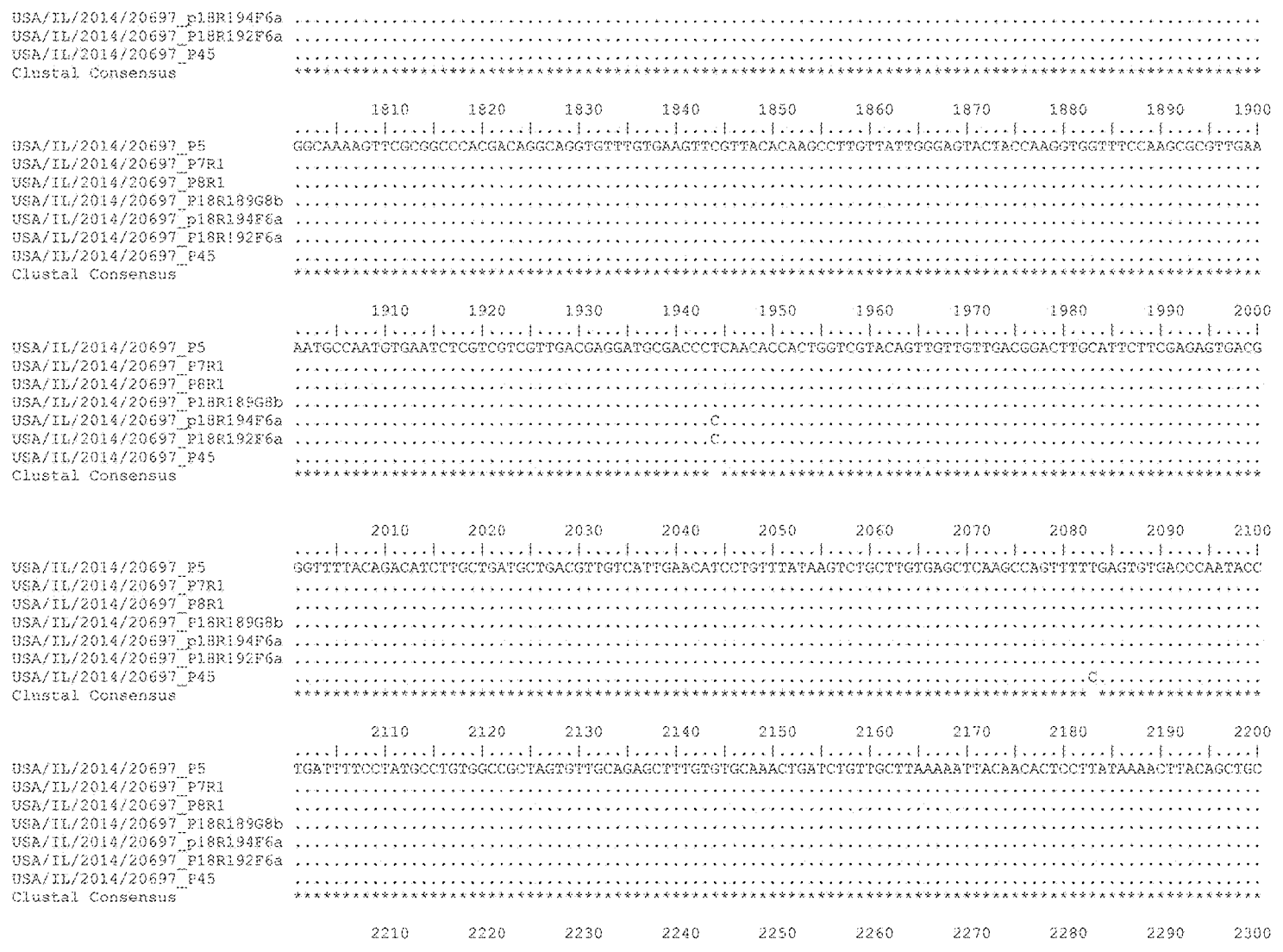
Figure 26F:
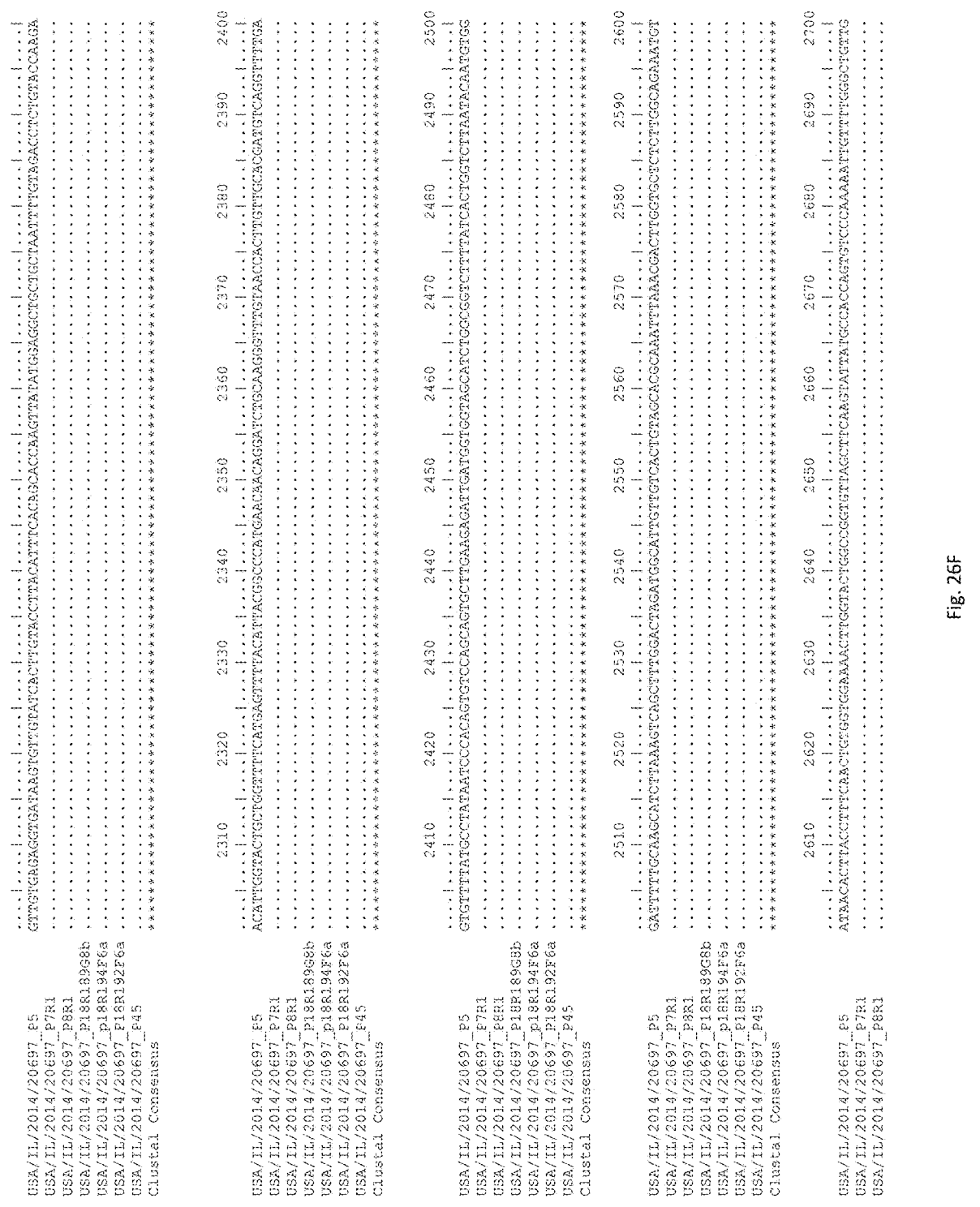
Figure 26G:
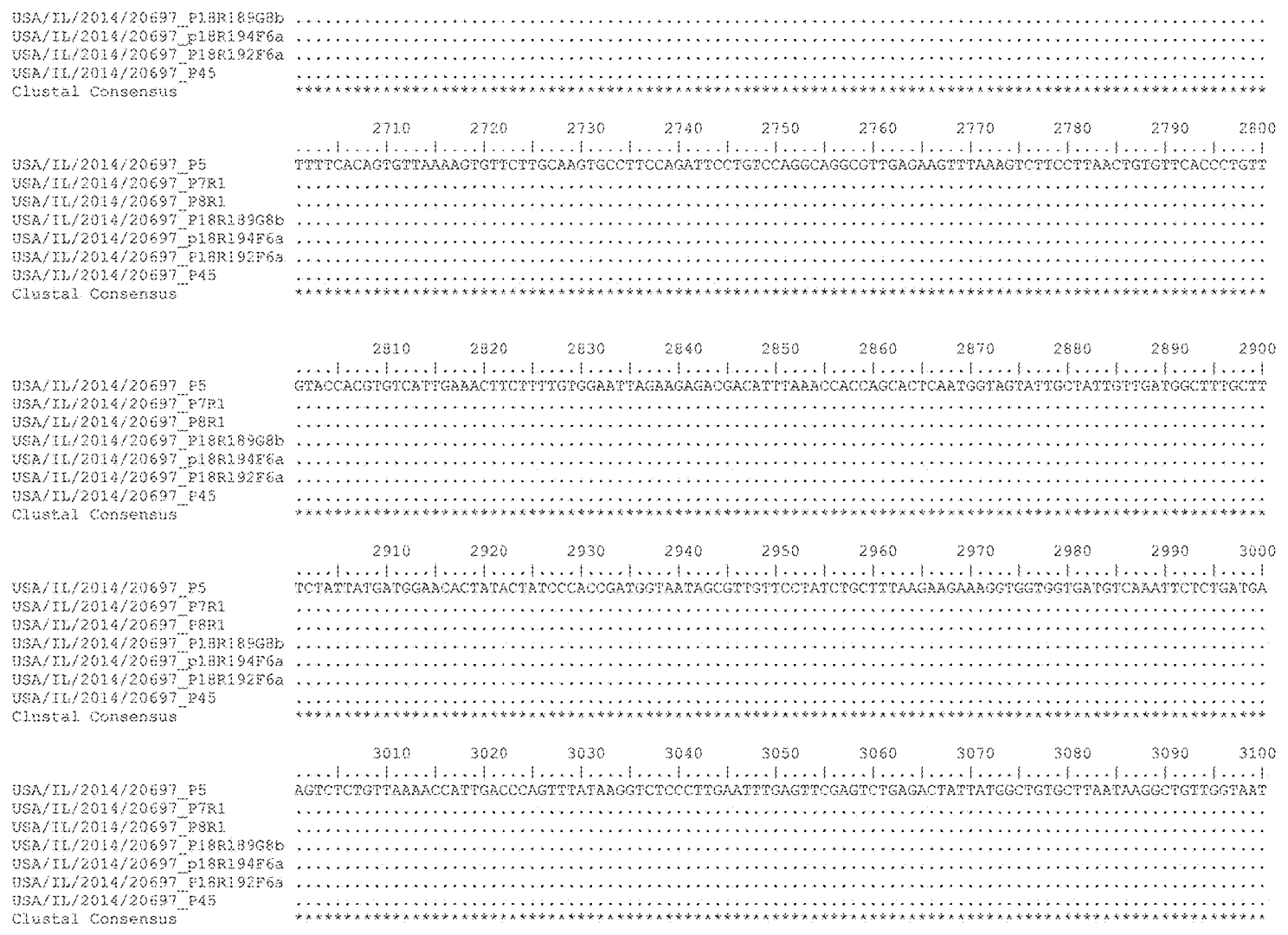
Figure 26H:
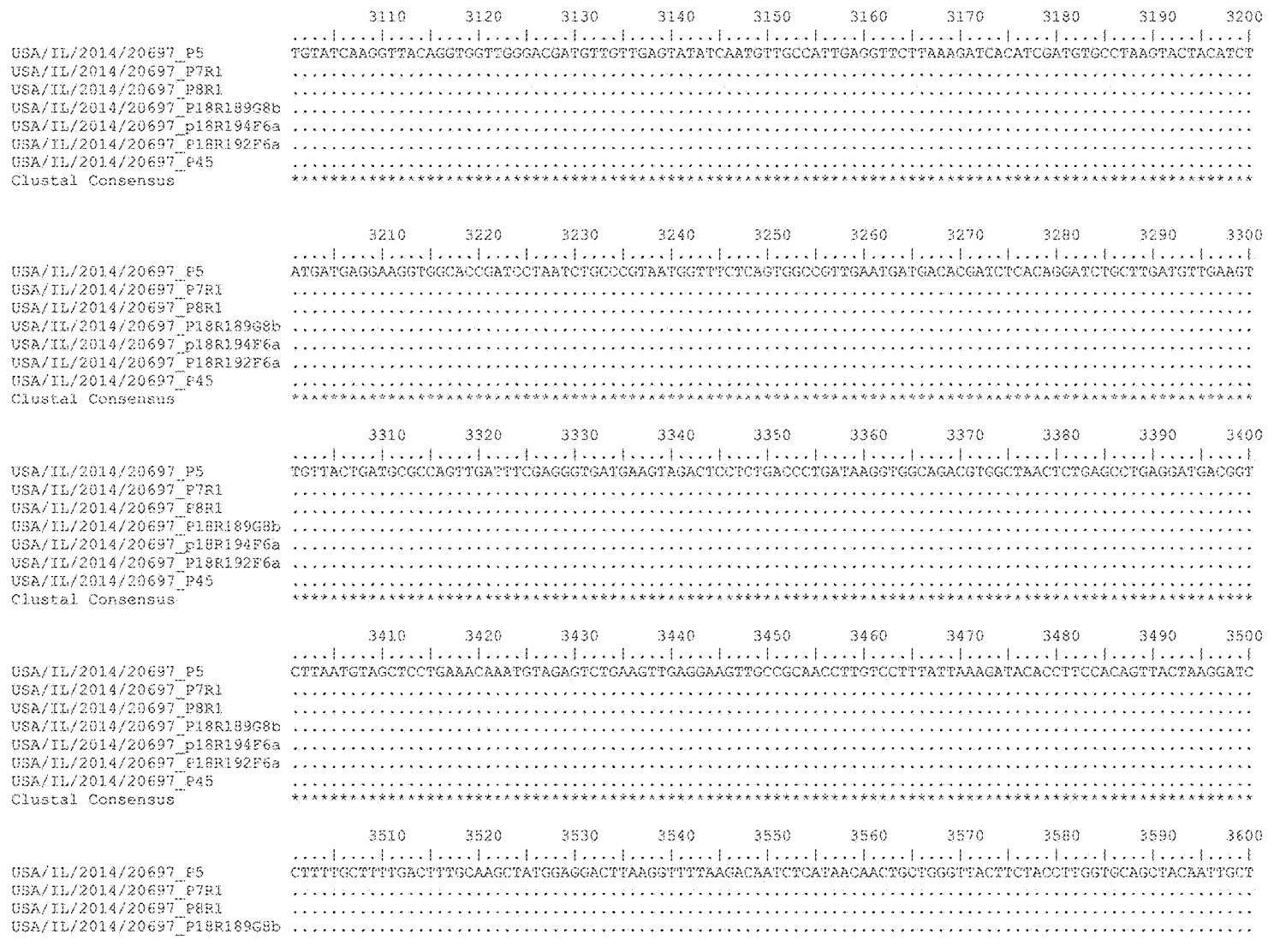
Figure 26I:
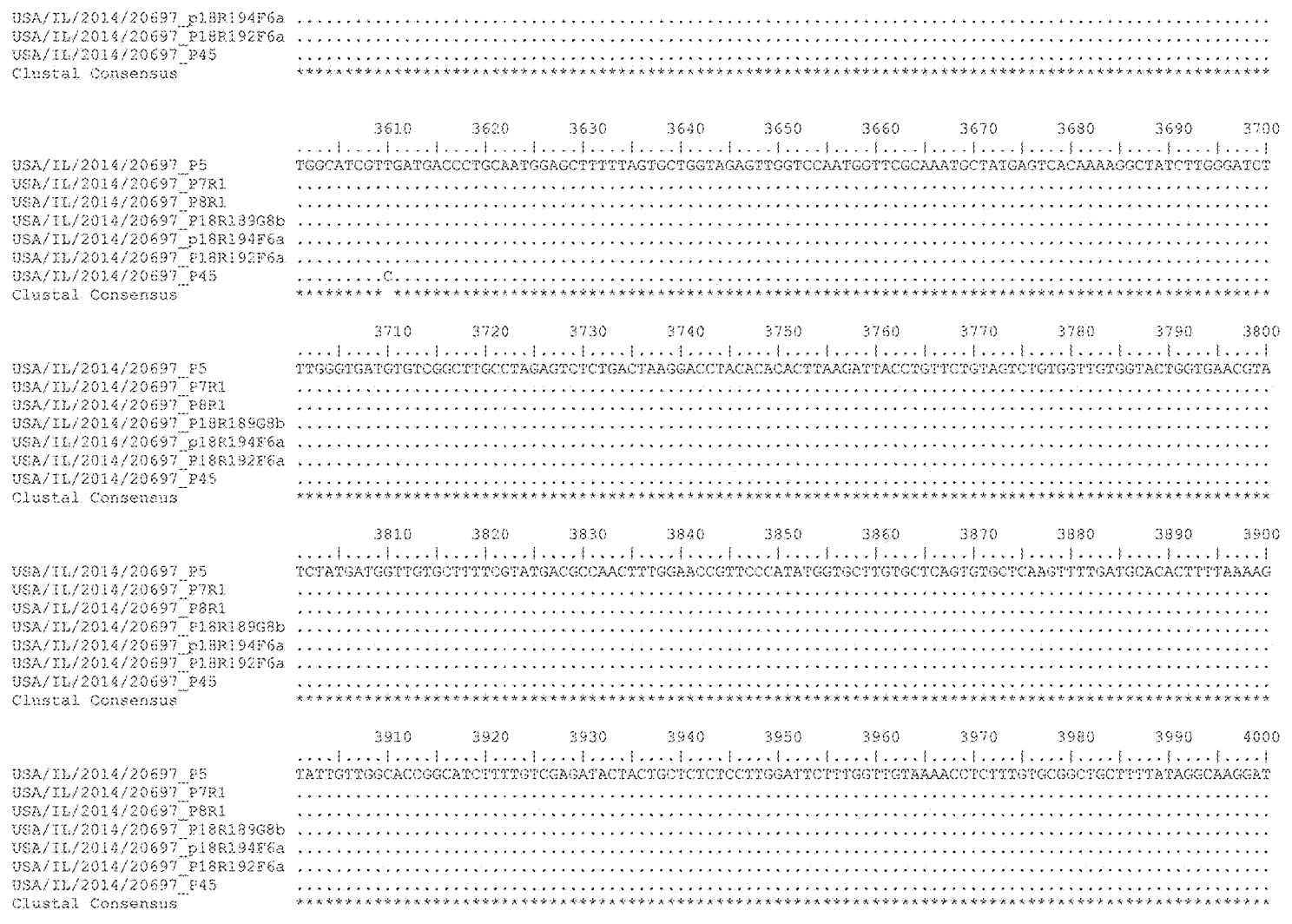
Figure 26J:
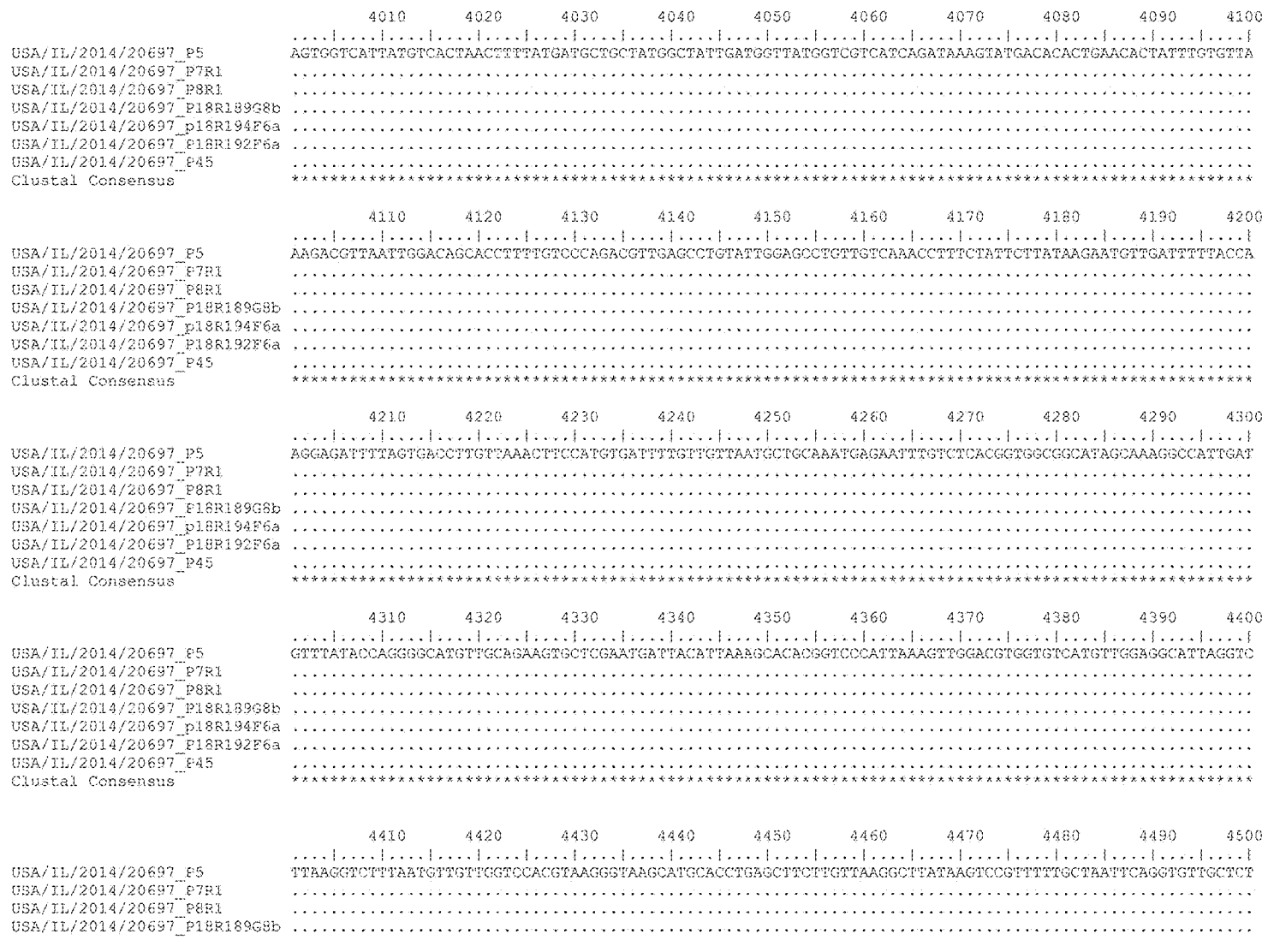
Figure 26L:
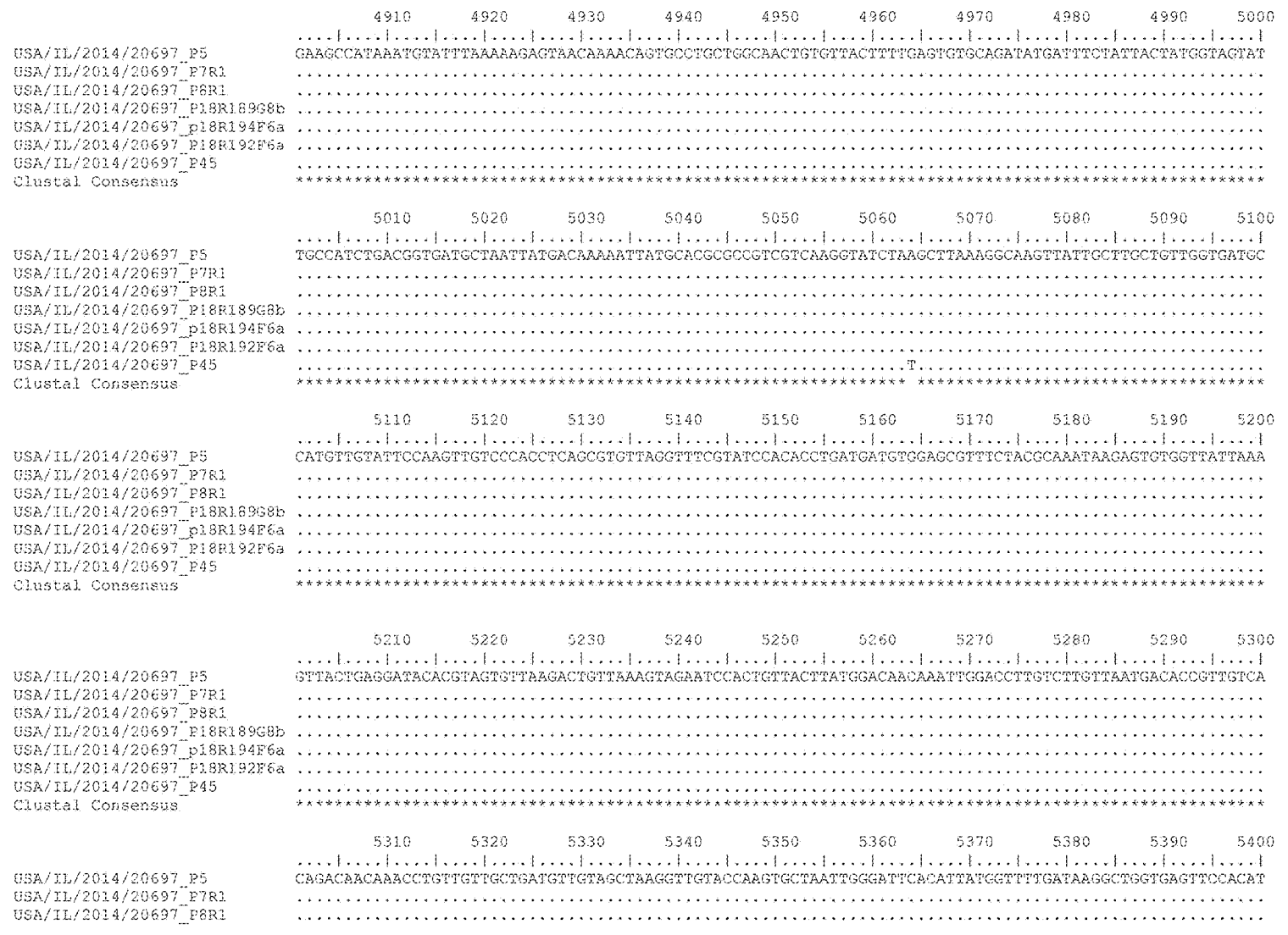
Figure 26M:
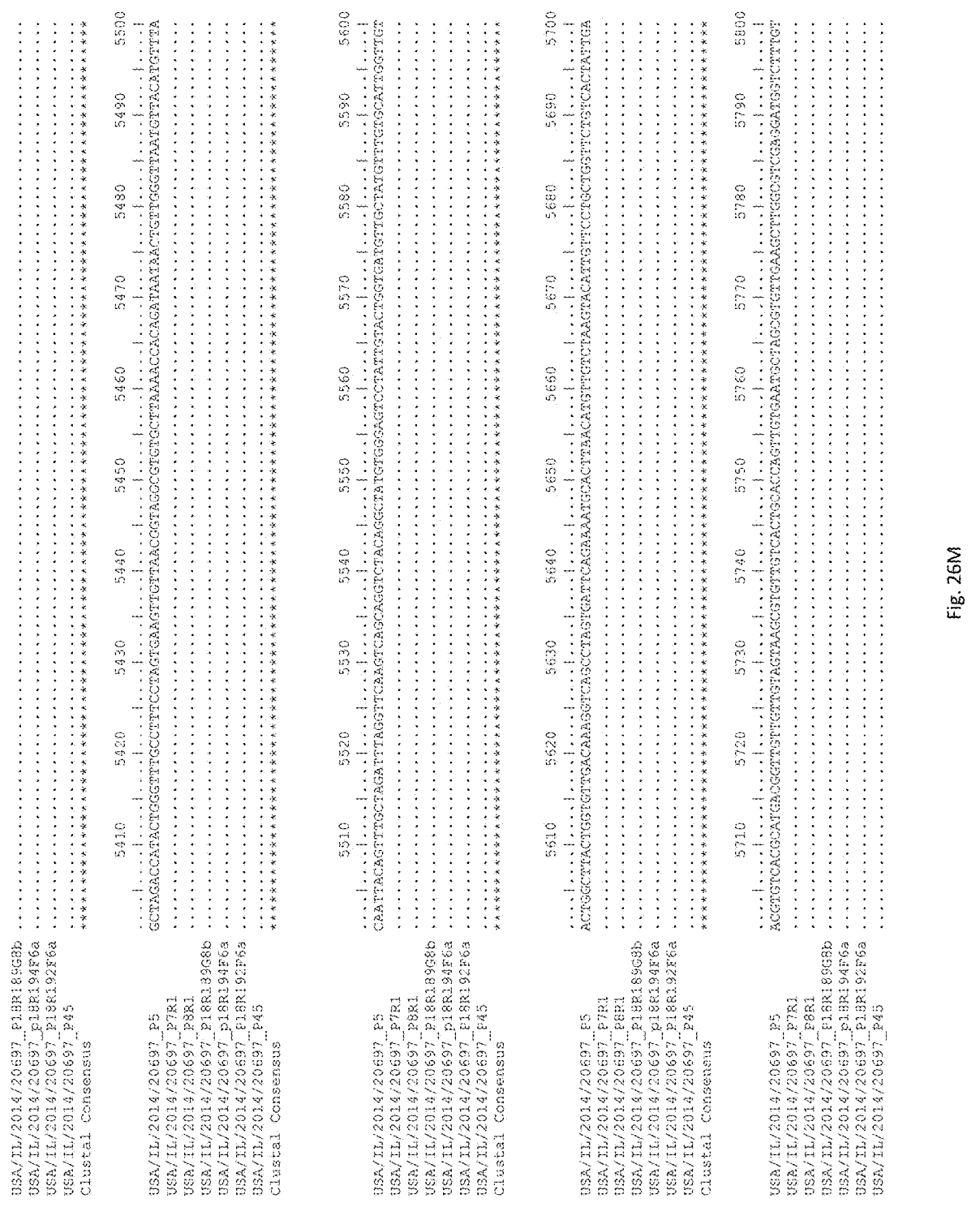
Figure 26N:
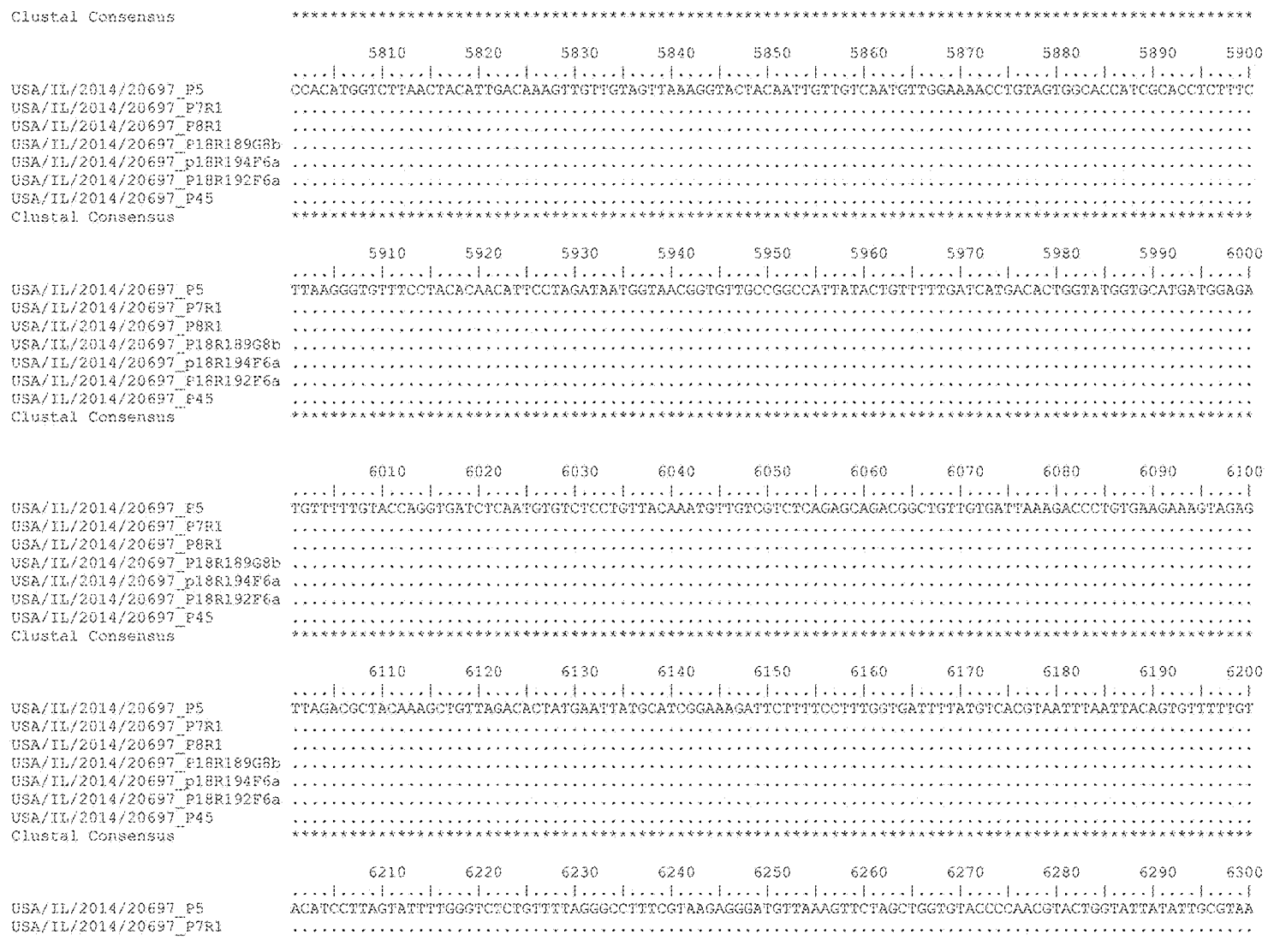
Figure 26P:
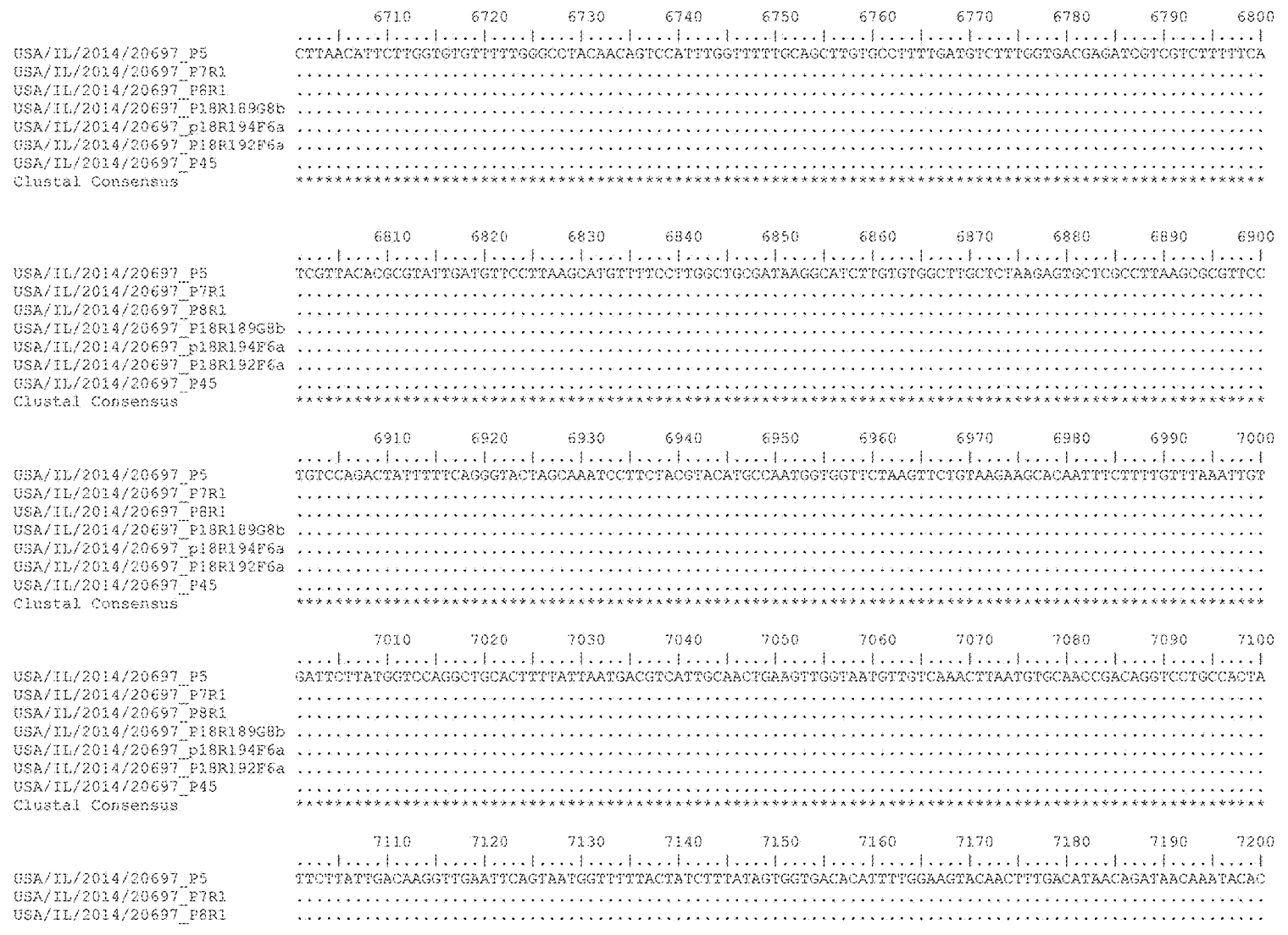
Figure 26Q:
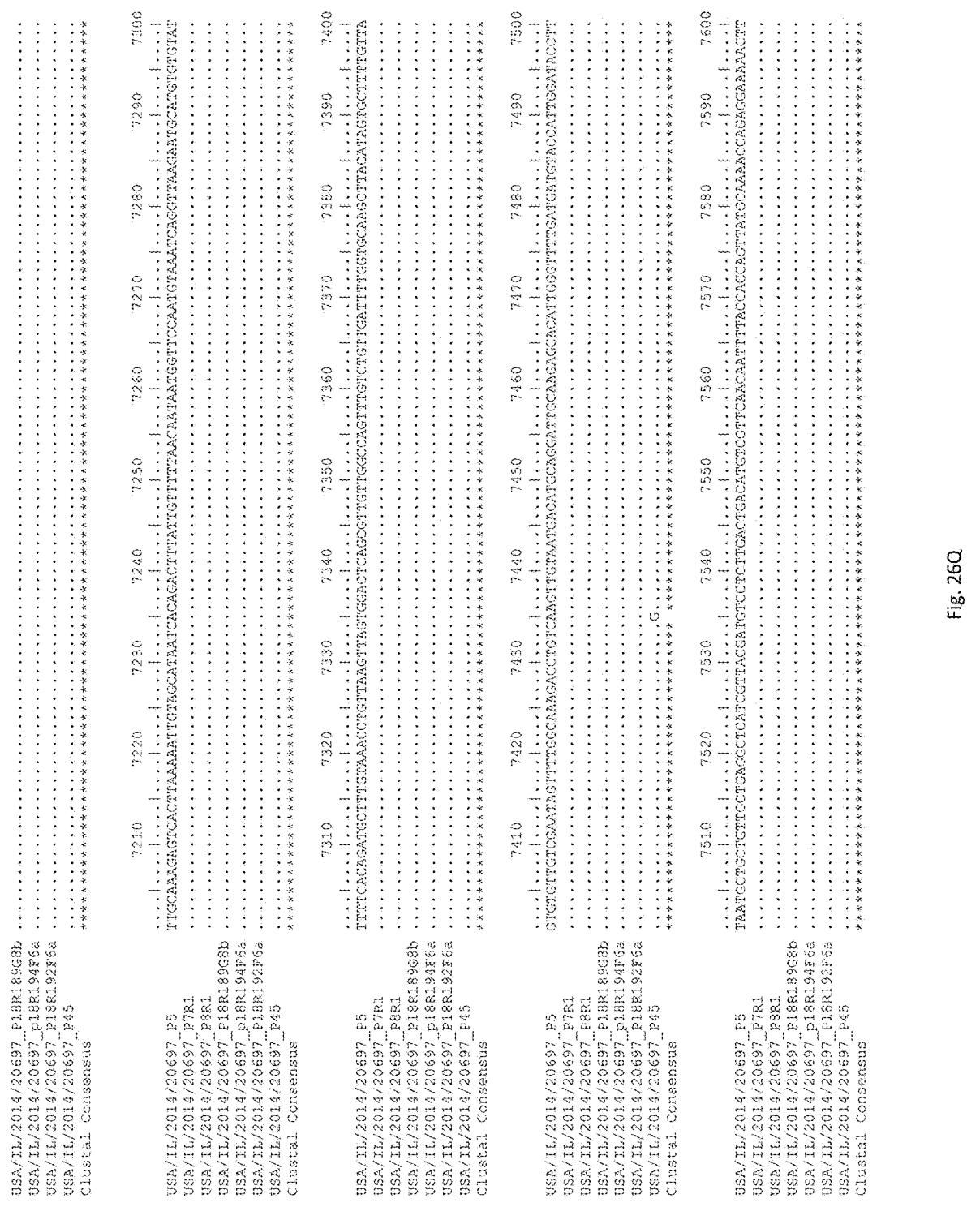
Figure 26R:
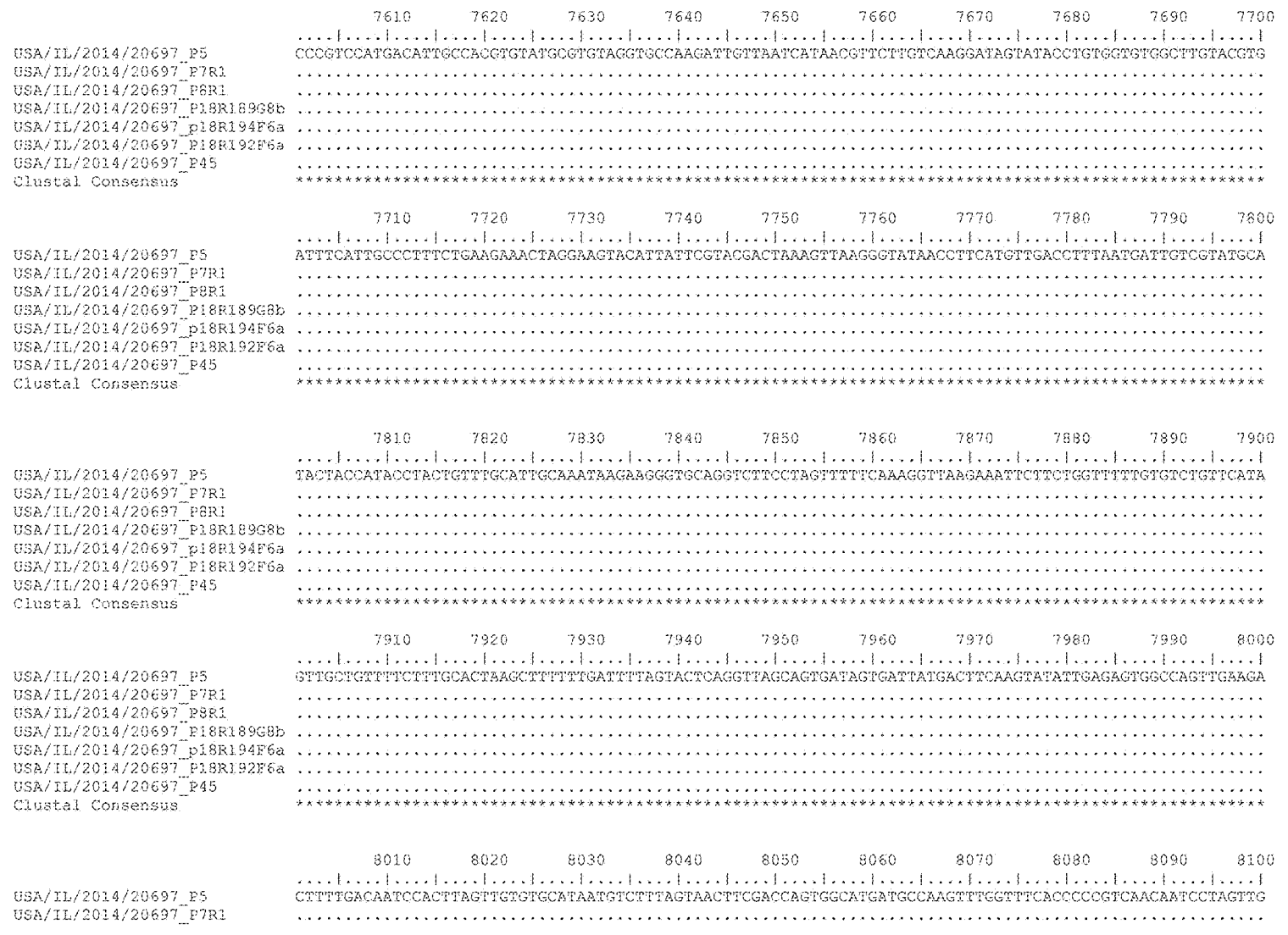
Figure 26S:
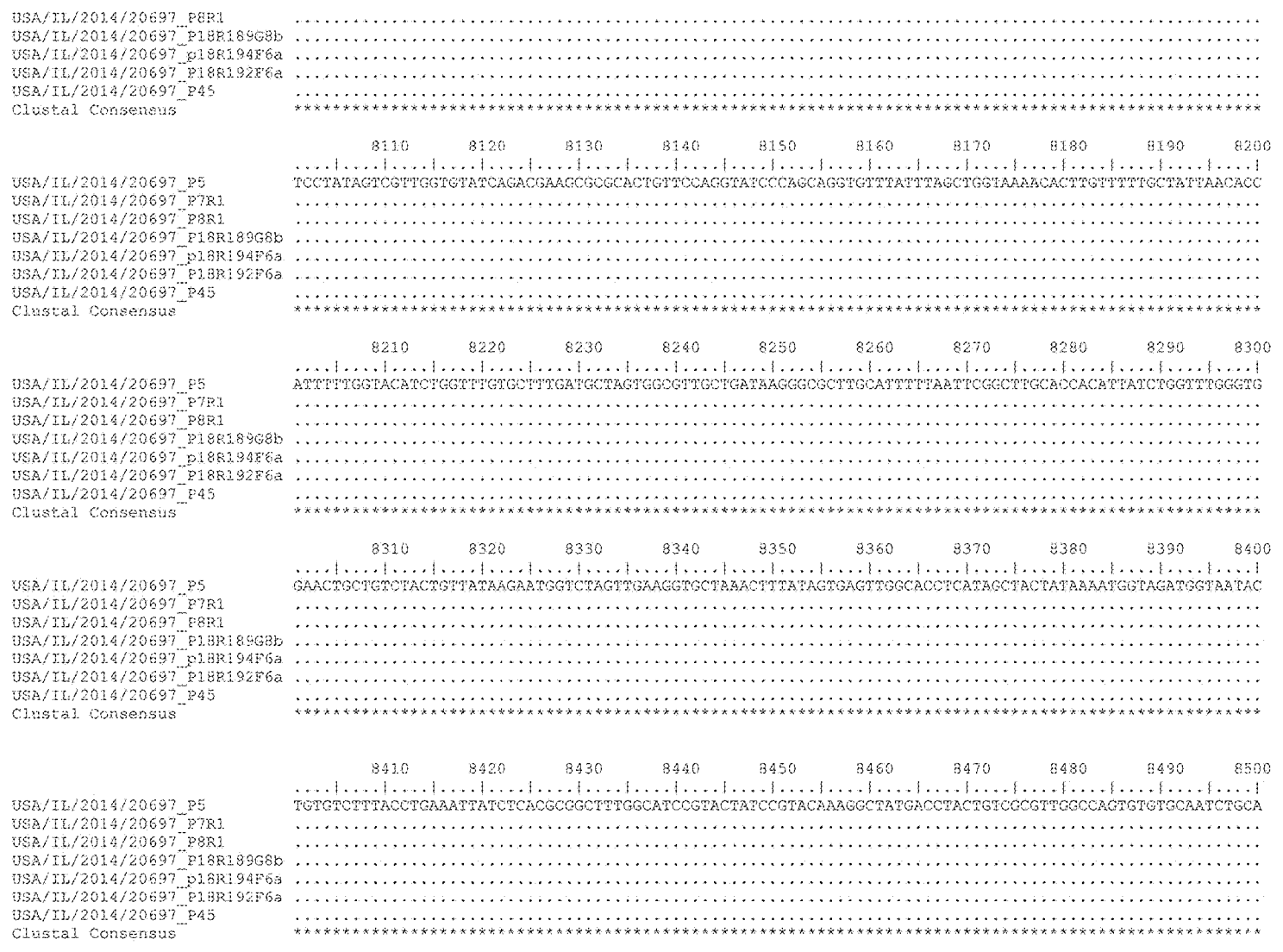
Figure 26T:
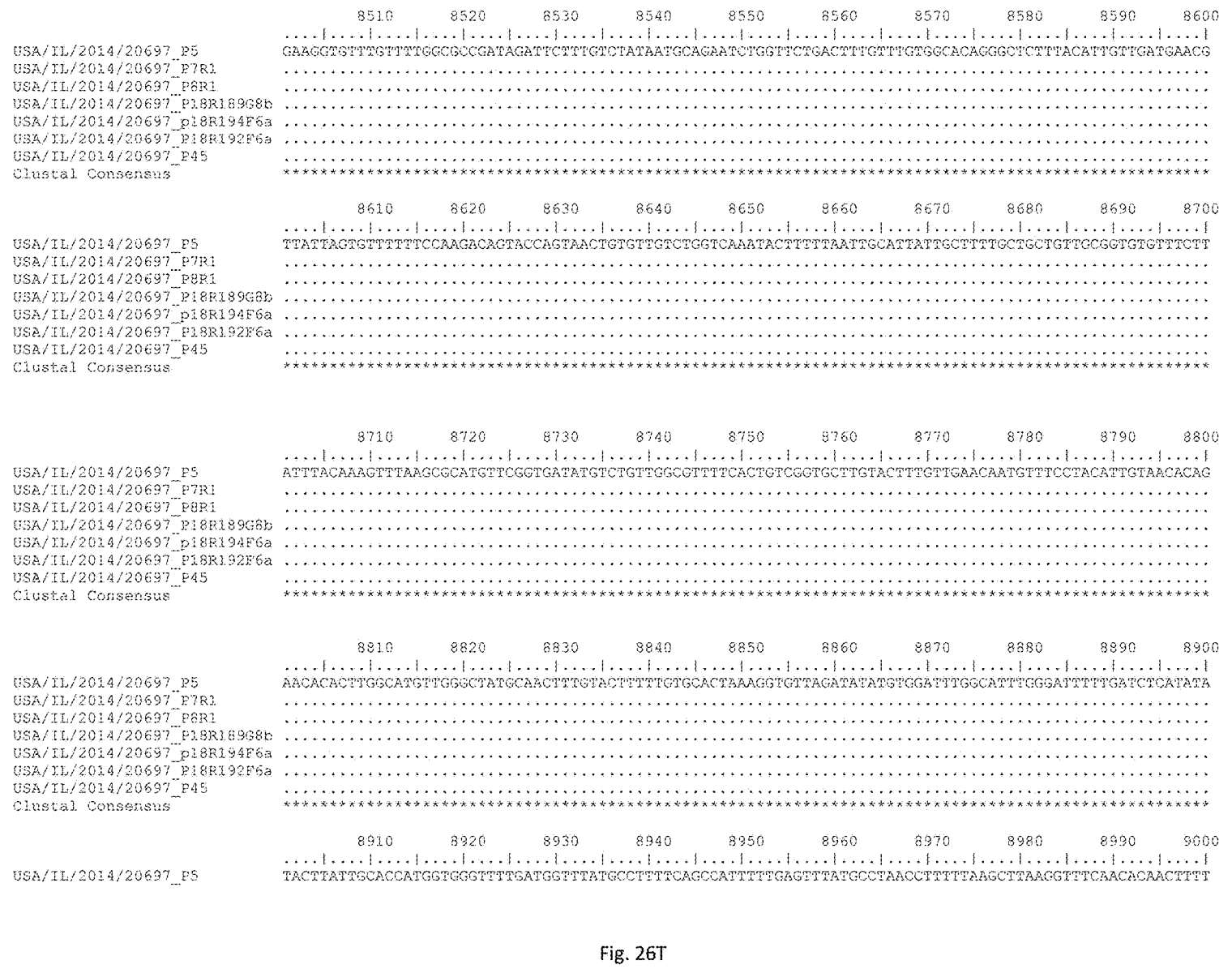
Figure 26U:
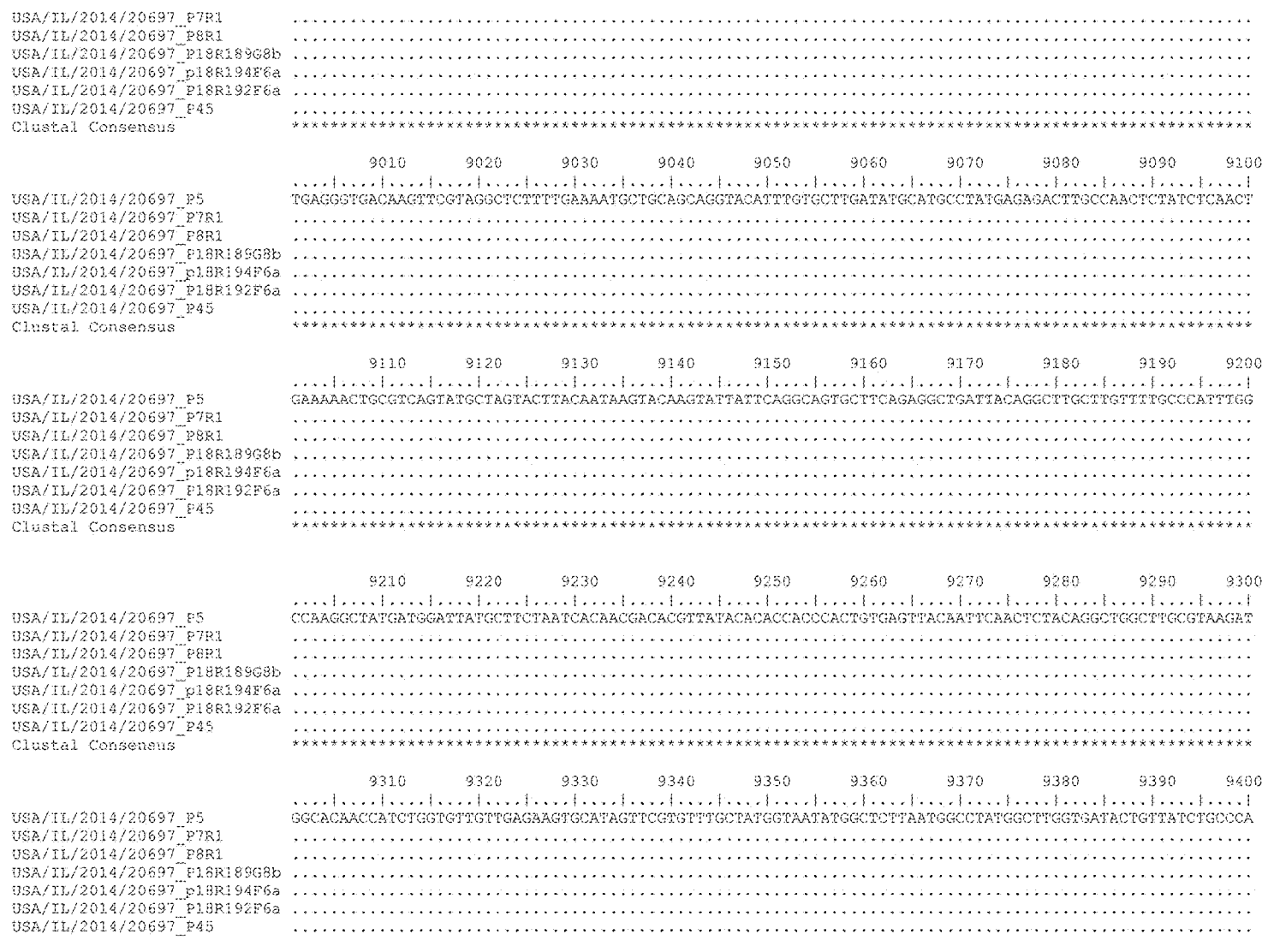
Figure 26V:
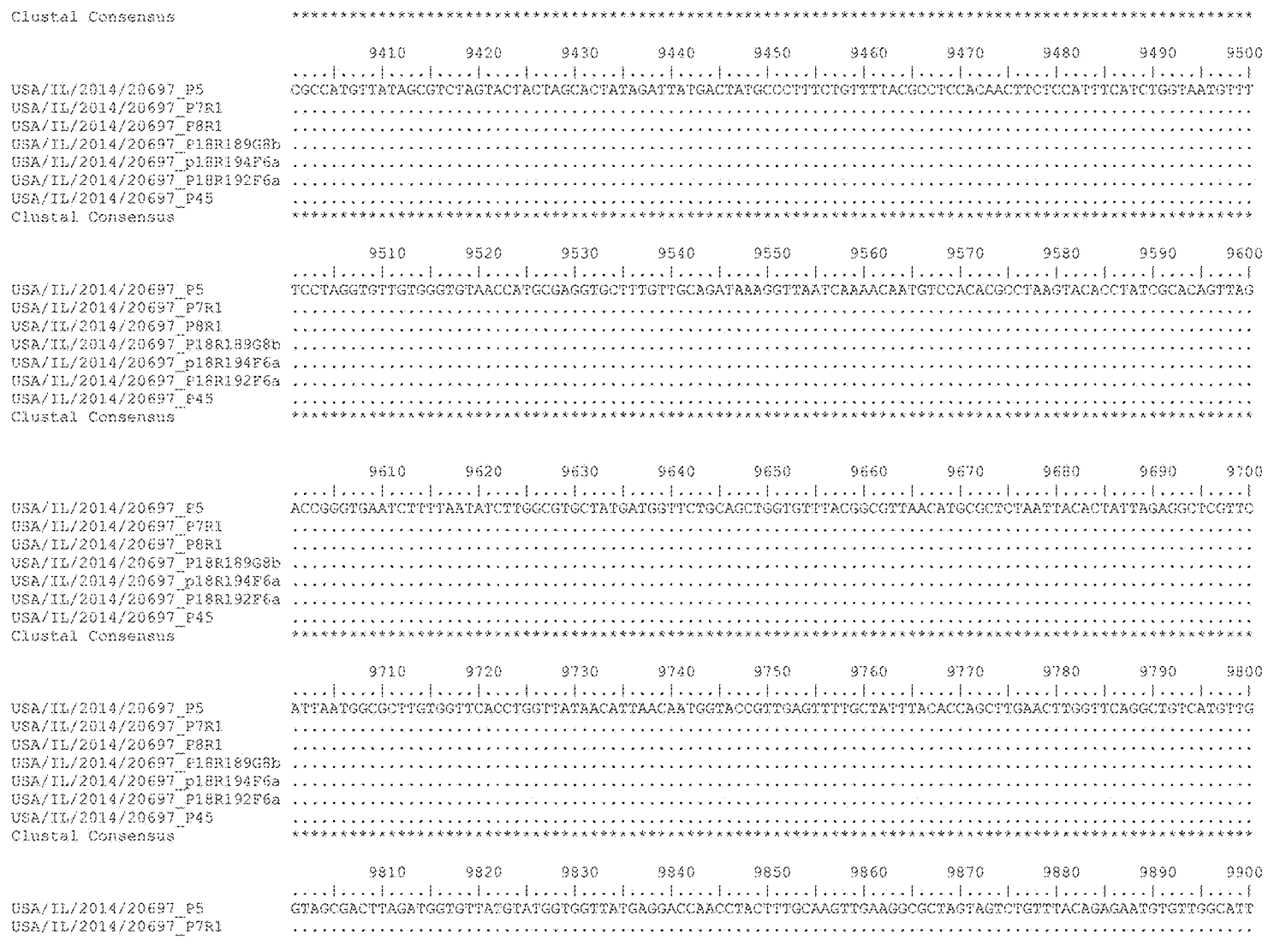
Figure 26X:
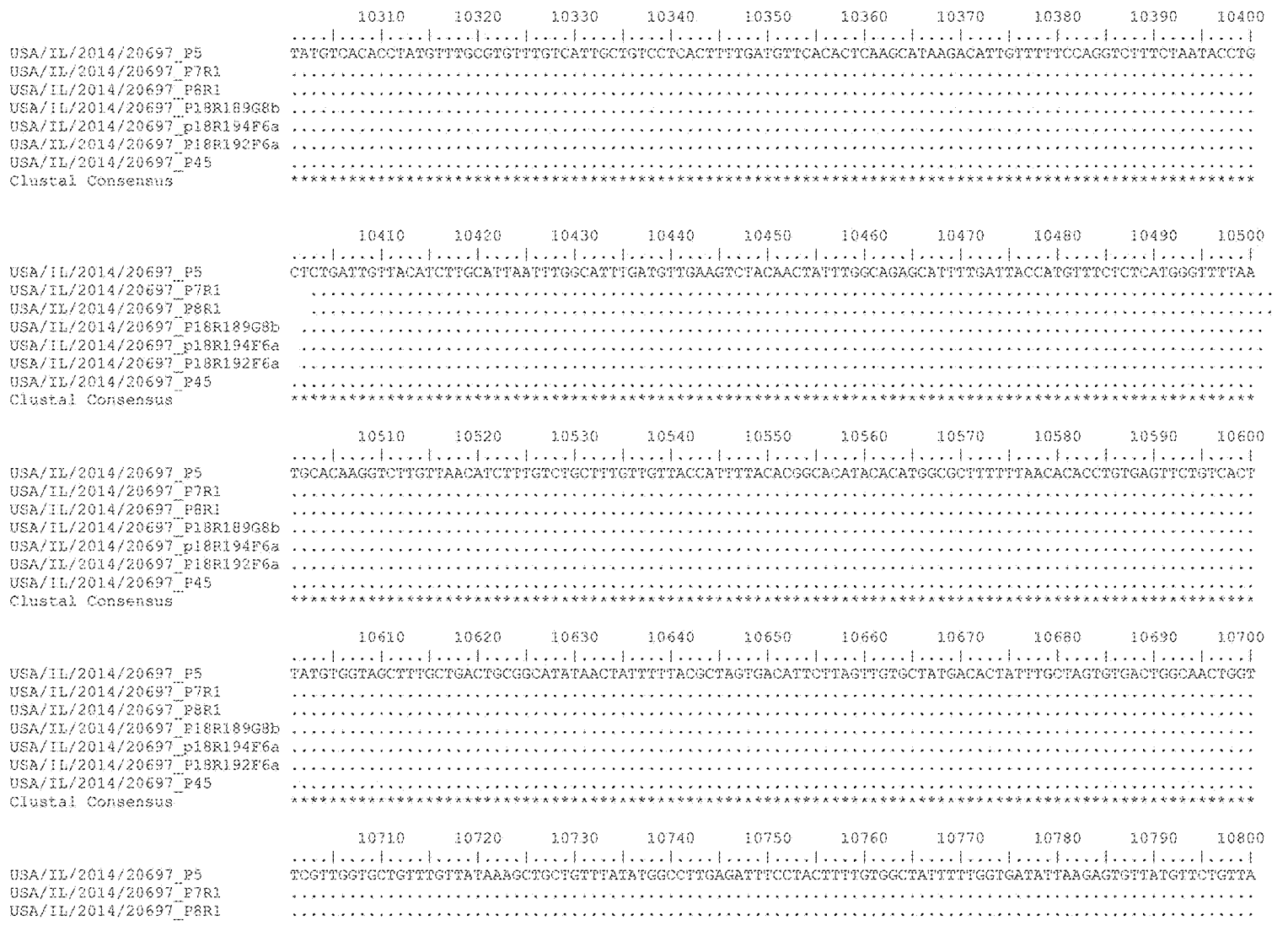
Figure 26Y:
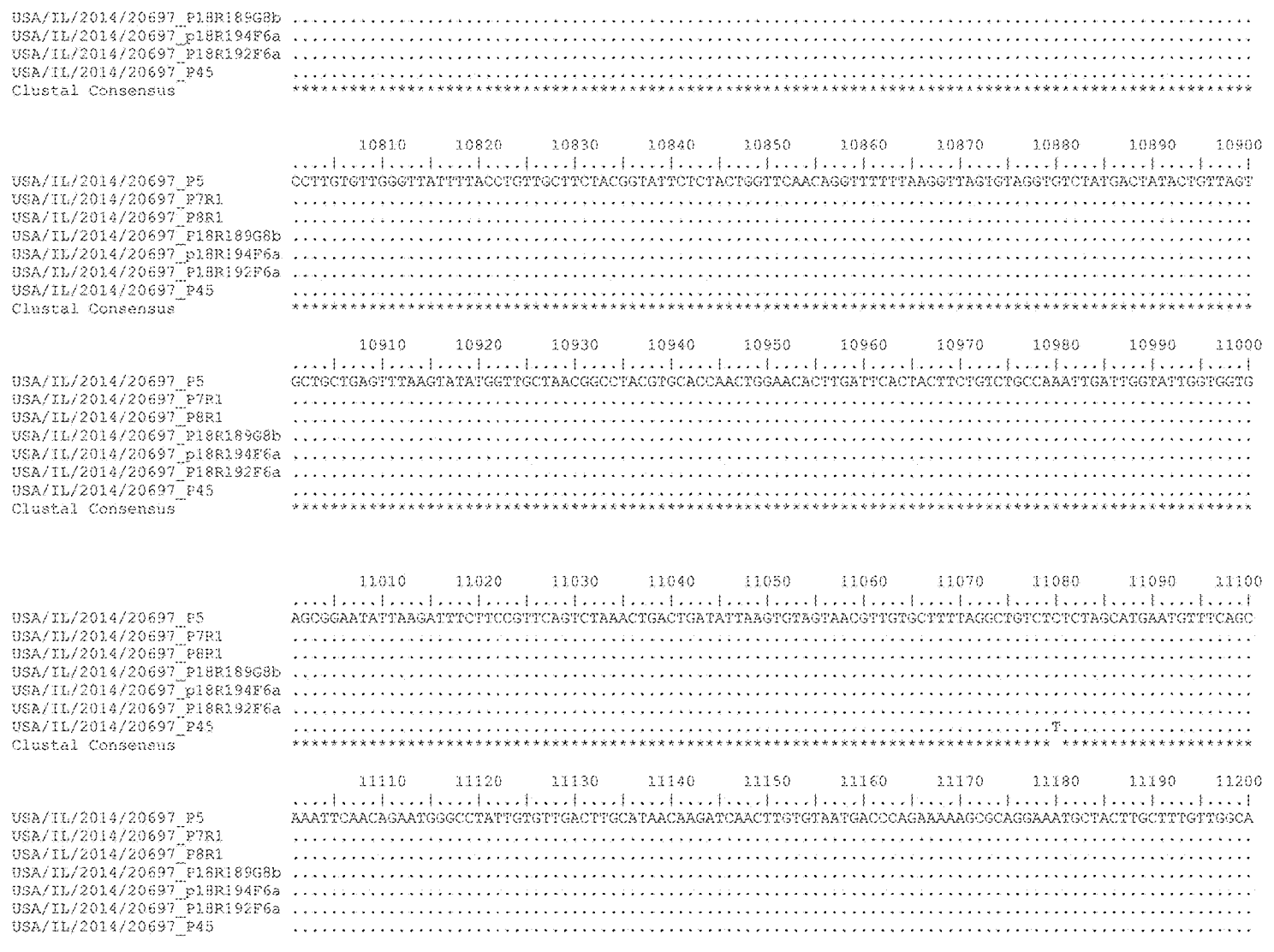
Figure 26Z:
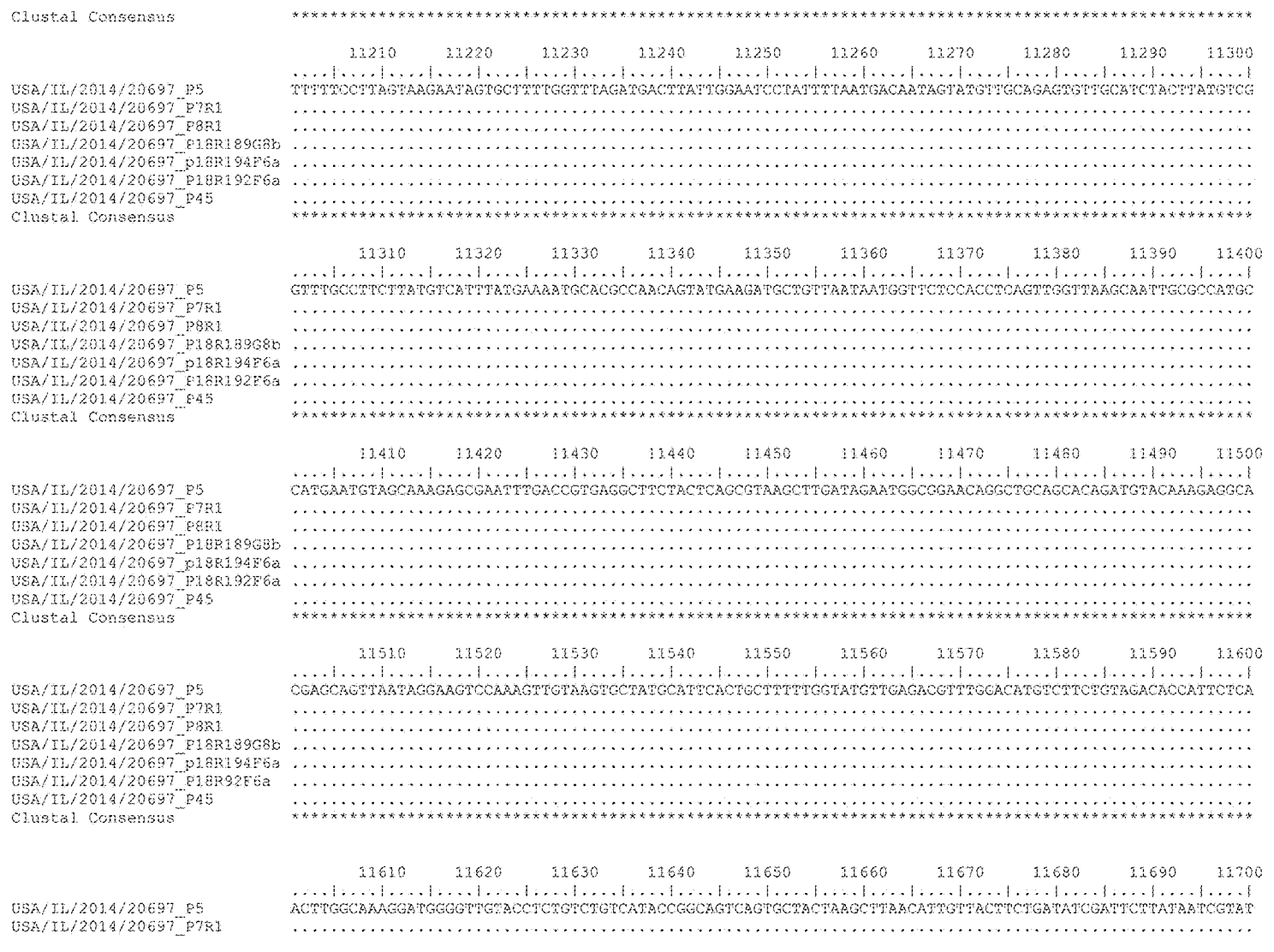
Figure 26J:
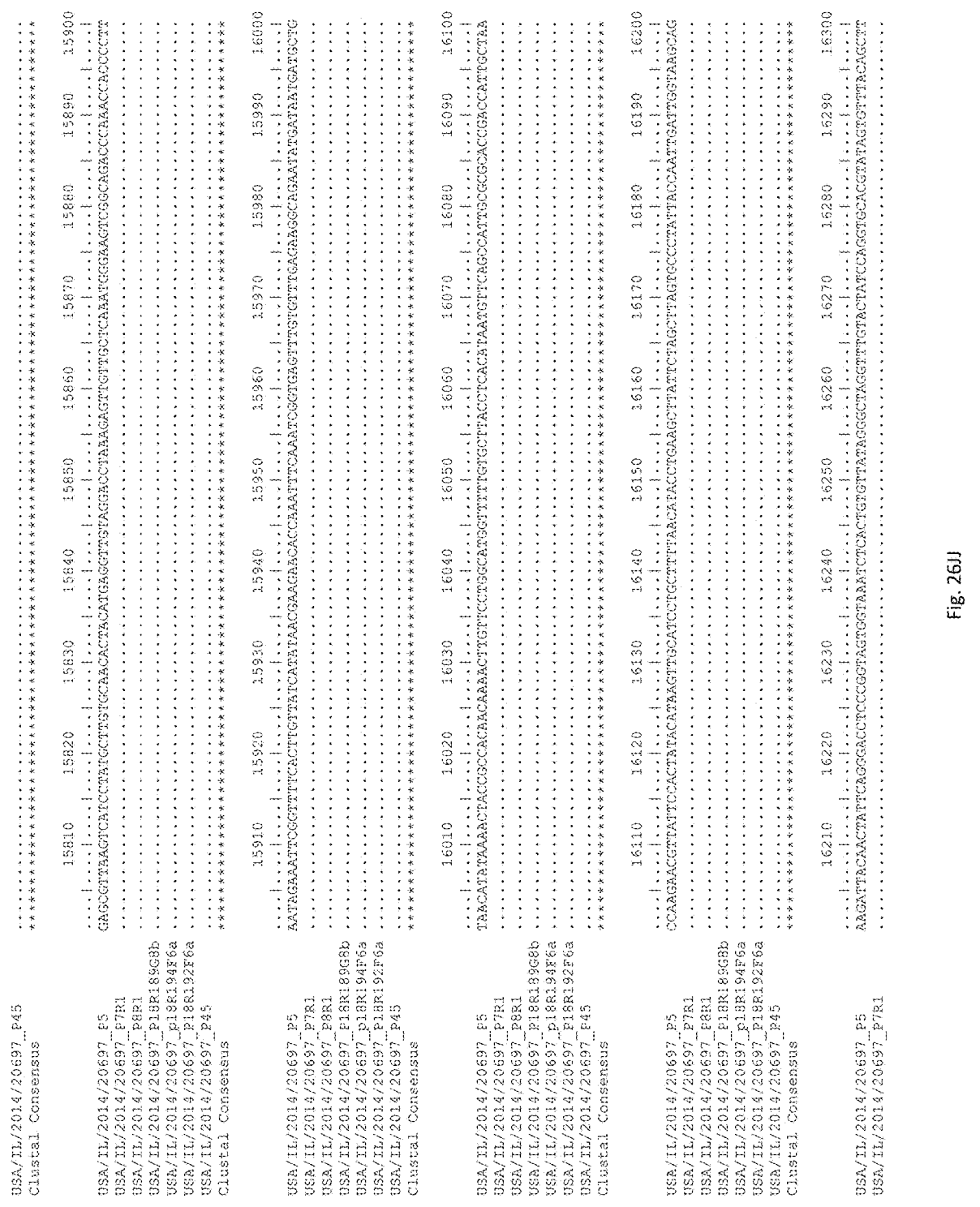
Figure 26:
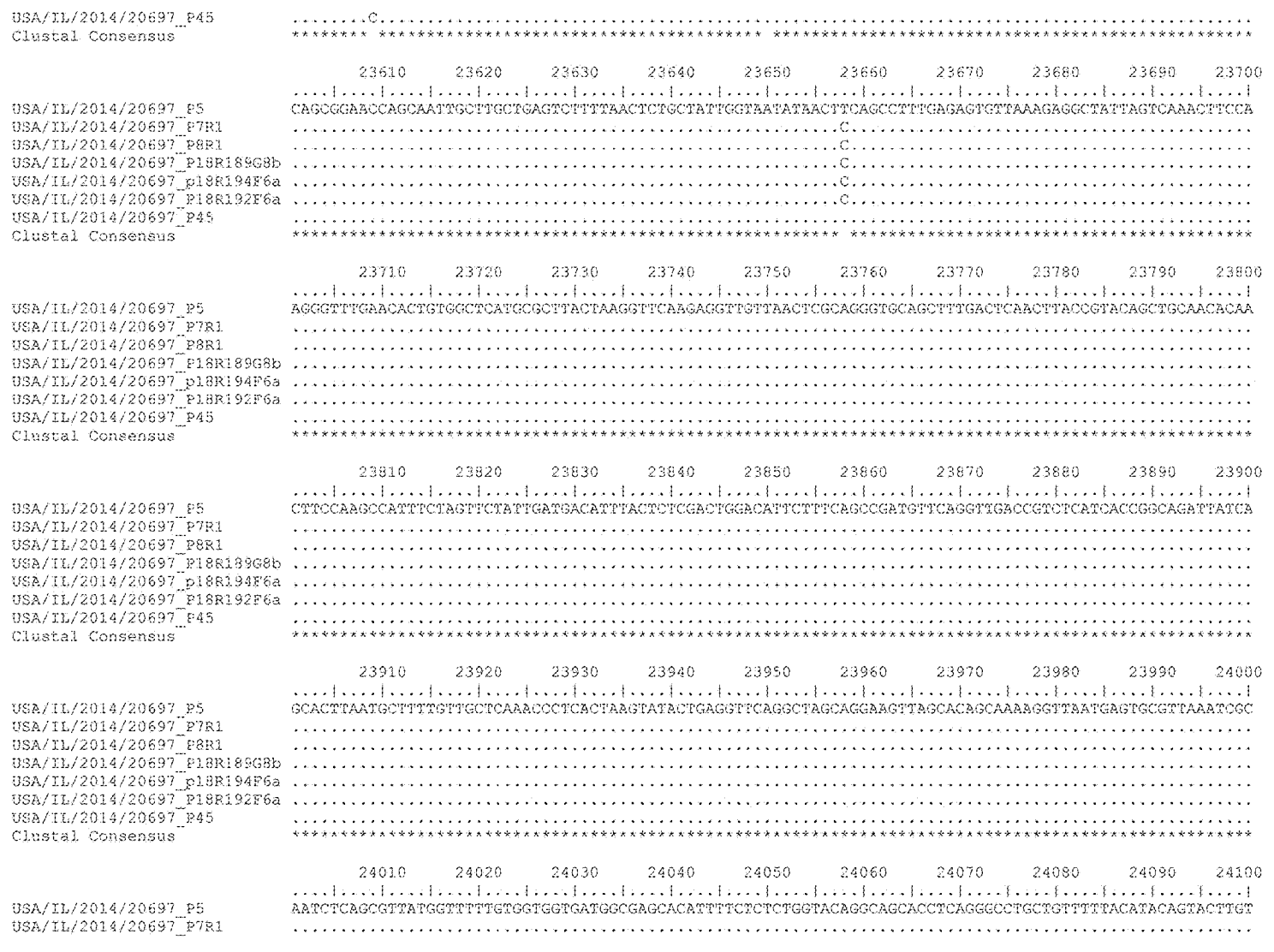
Figure 26:
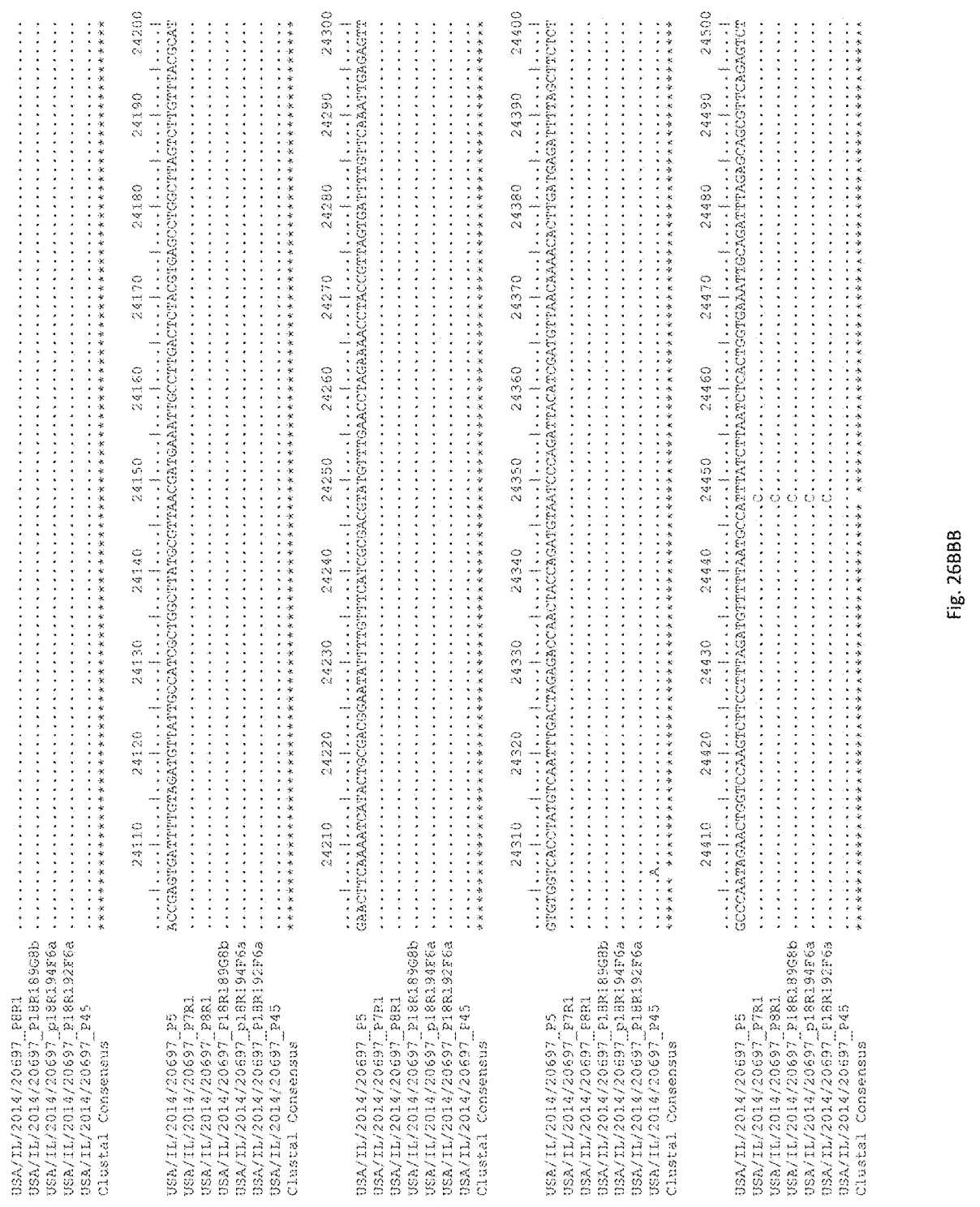
Figure 26:
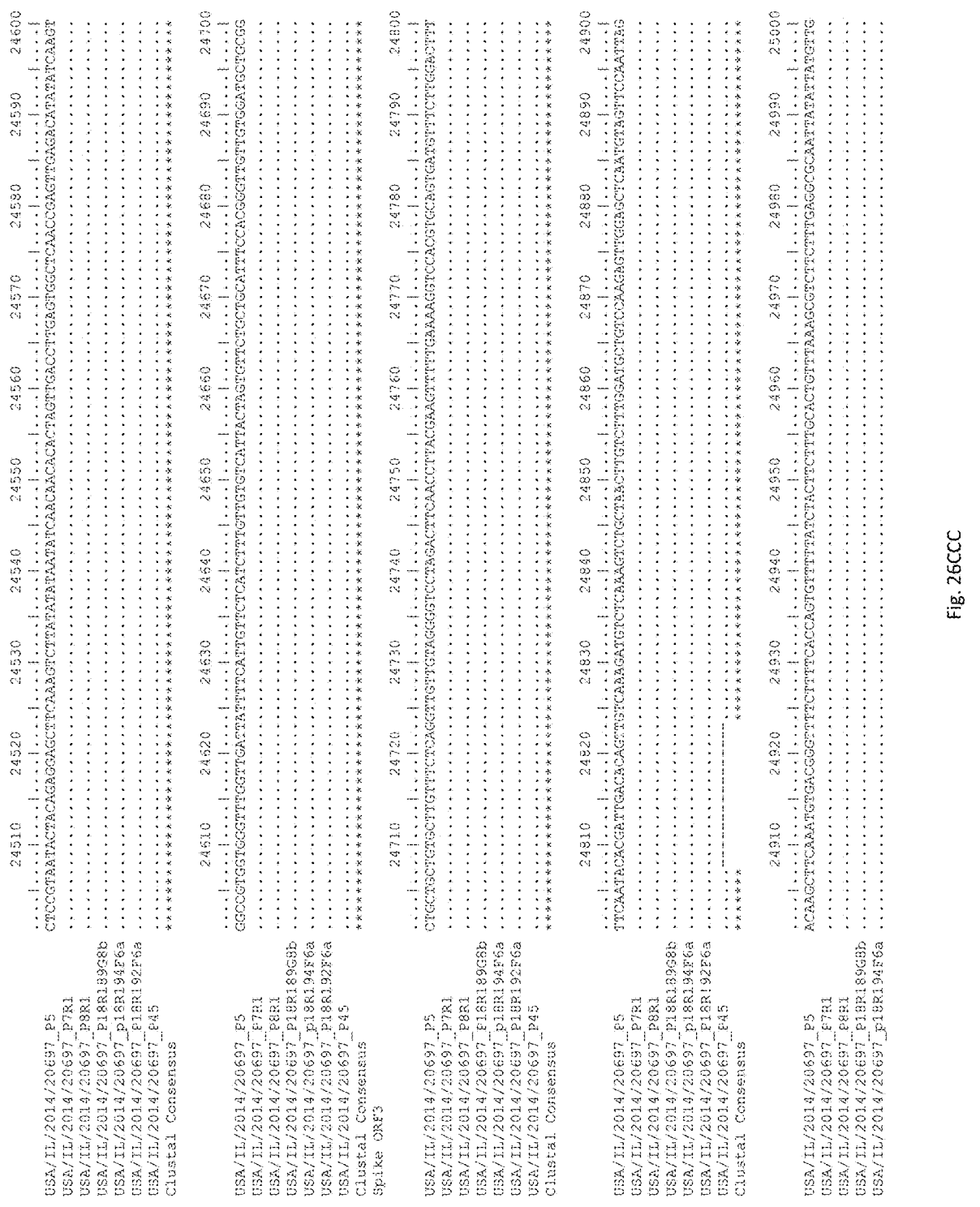
Figure 26:
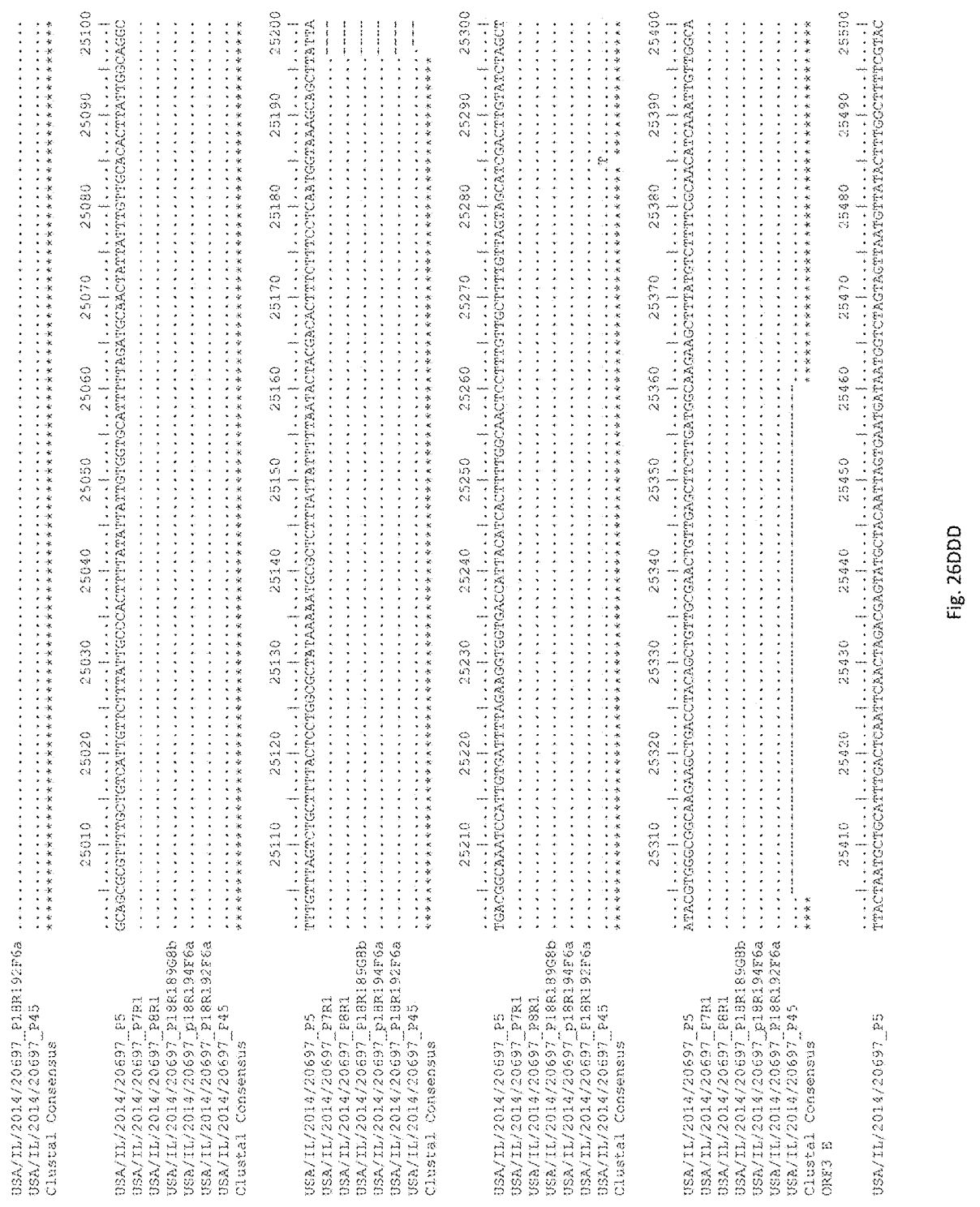
Figure 26:
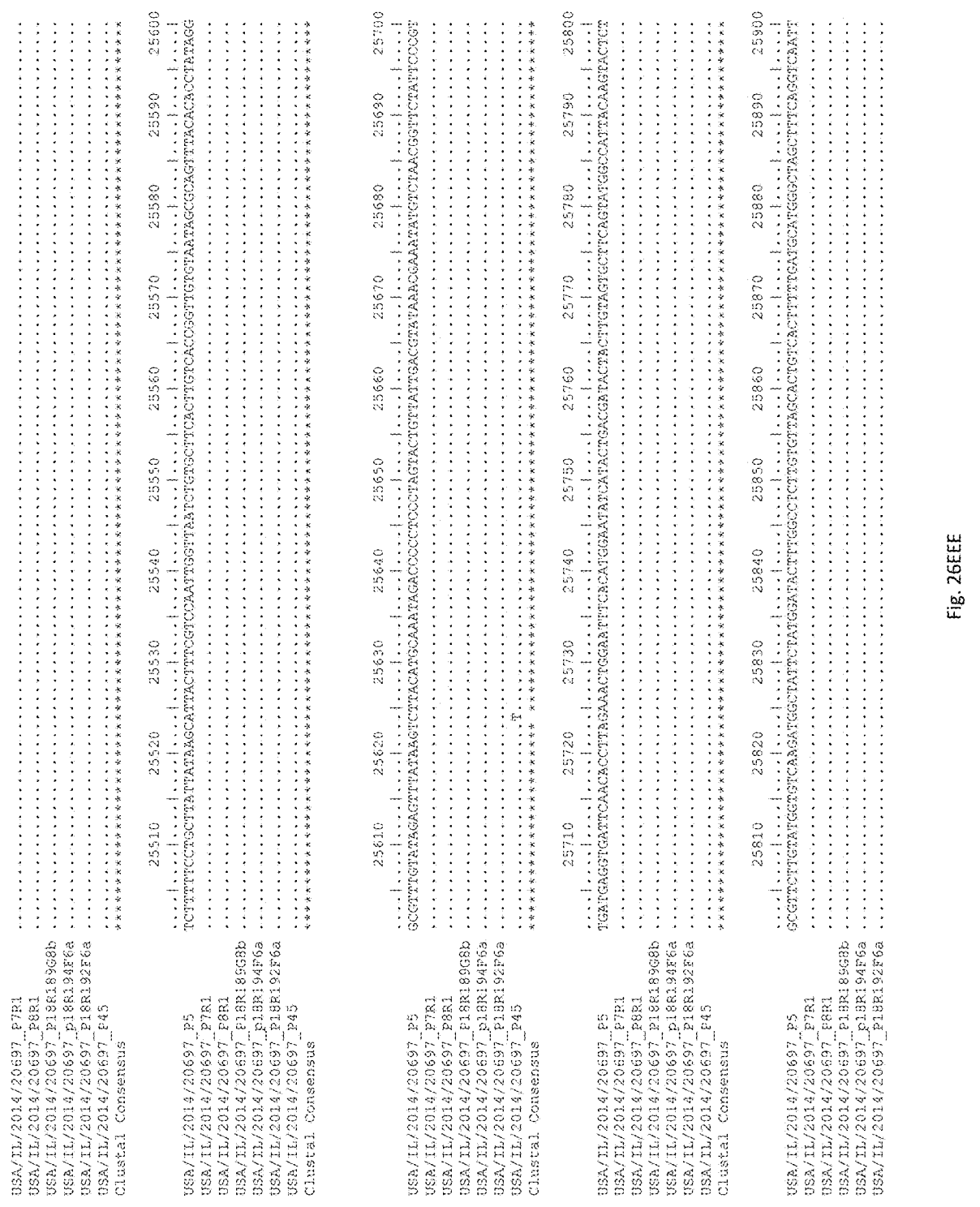
Figure 26:
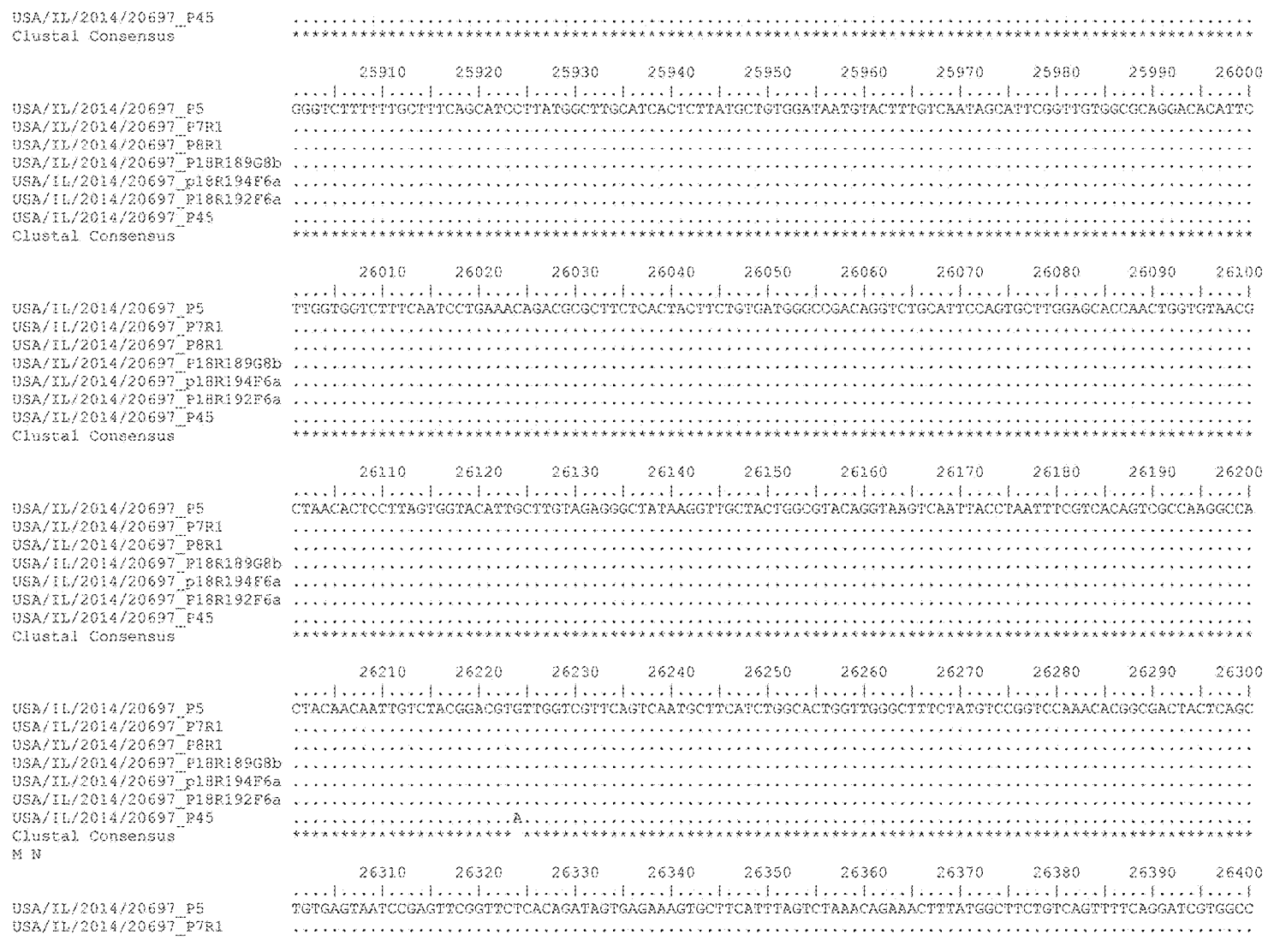
Figure 26:
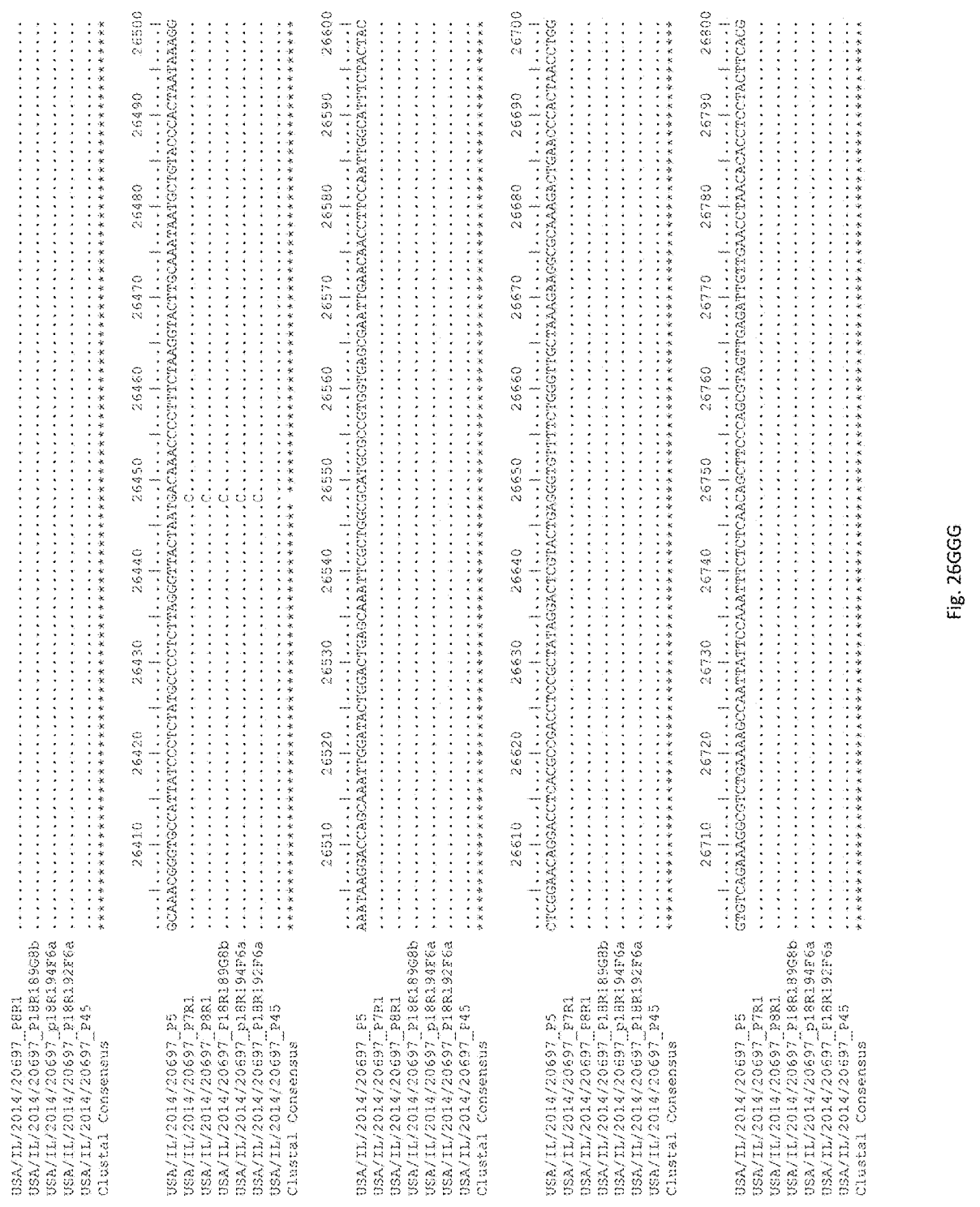
Figure 26:
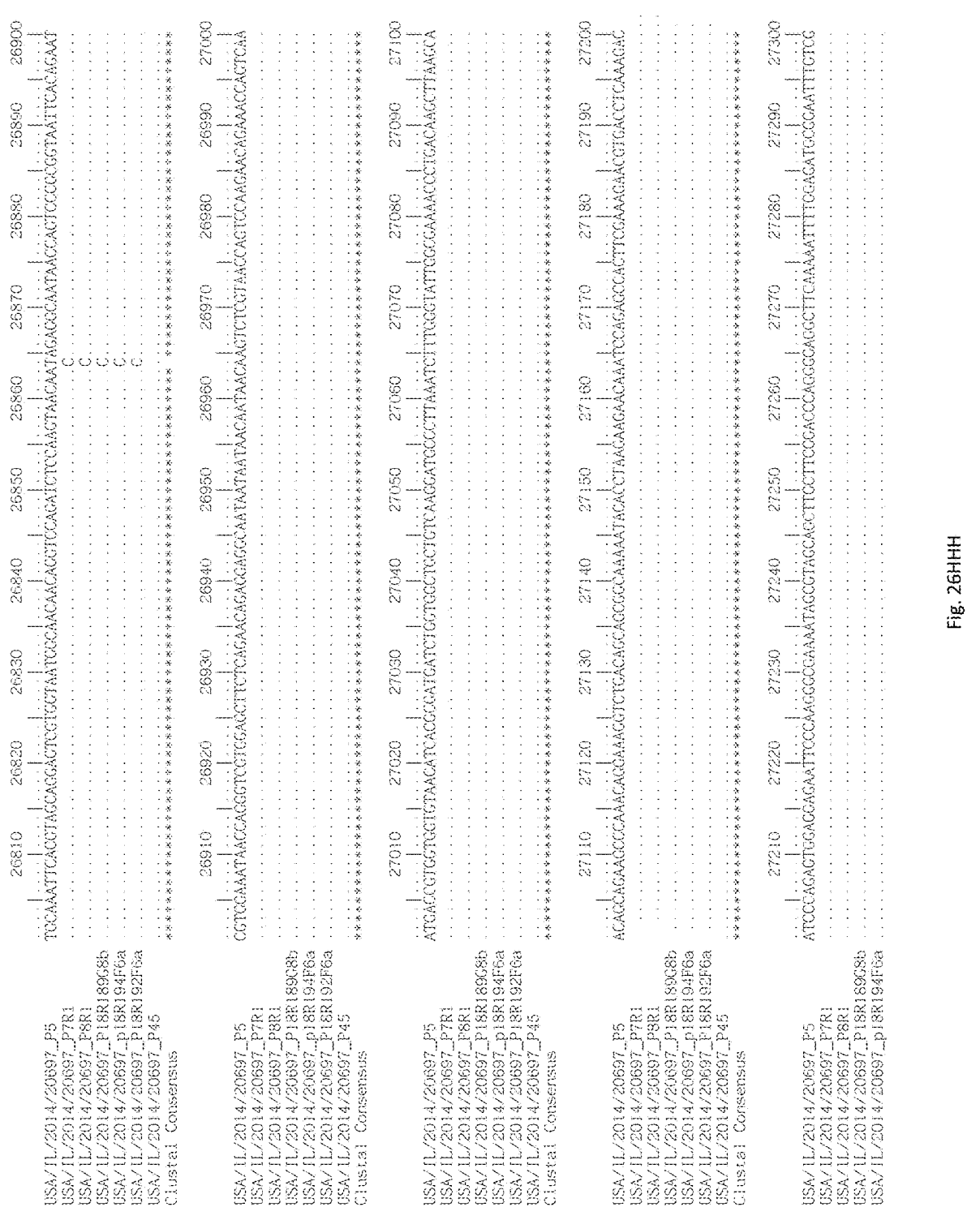
Figure 26:
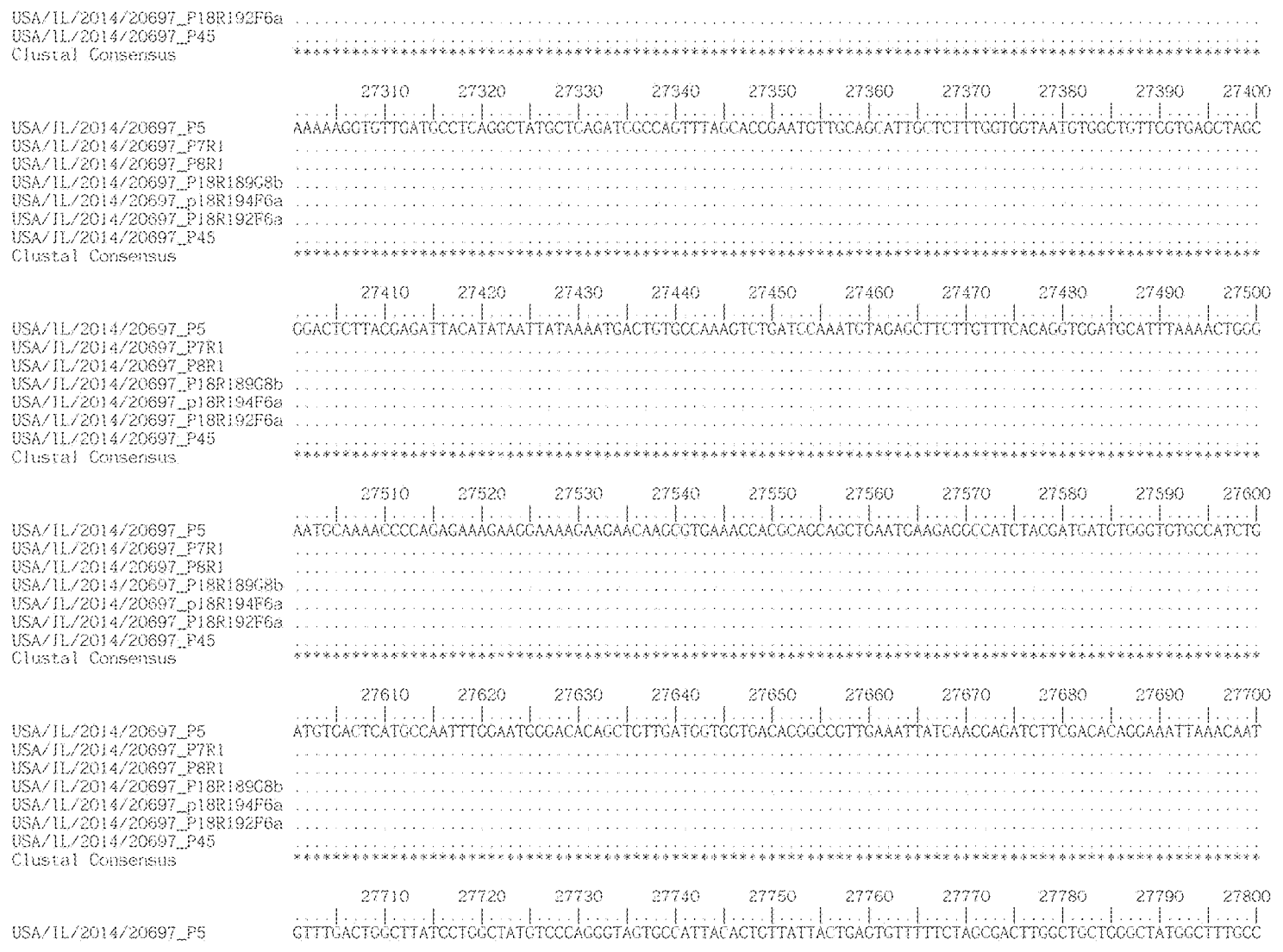

FIGS. 26A to 26JJJ are a comparison of the genomic nucleotide sequences of 2014020697-P5 passages 5, lineage 1 (P5) (SEQ ID NO:8), 2014020697-P7R1 passage 7, lineage 2 (SEQ ID NO:15), 2014020697-P8R1 passage 8, lineage 2 (SEQ ID NO:35), 2014020697-P18R1 passage 18, lineage 2 clone G8b (SEQ ID NO:36), 2014020697-P18R1 passage 18, lineage 2 clone F6a (SEQ ID NO:37) and 2014020697-P45 passage 45, lineage 1 (SEQ ID NO:39).

FIGS. 27A-27C show sequences according to exemplary embodiments of the invention. The amino acid sequences of 2014020697-P45 passage 45, lineage 1 ORF1a/1b polyprotein (SEQ ID NO: 40); 2014020697-P45 passage 45, lineage 1 spike protein (SEQ ID NO:41); 2014020697-P45 passage 45, lineage 1 ORF3 protein (SEQ ID NO:42); 2014020697-P45 passage 45, lineage 1 envelope protein (SEQ ID NO:43); 2014020697-P45 passage 45, lineage 1 membrane protein (SEQ ID NO:44); and 2014020697-P45 passage 45, lineage 1 nucleocapsid protein (SEQ ID NO:45) are shown.

Figures 28A, 28B:
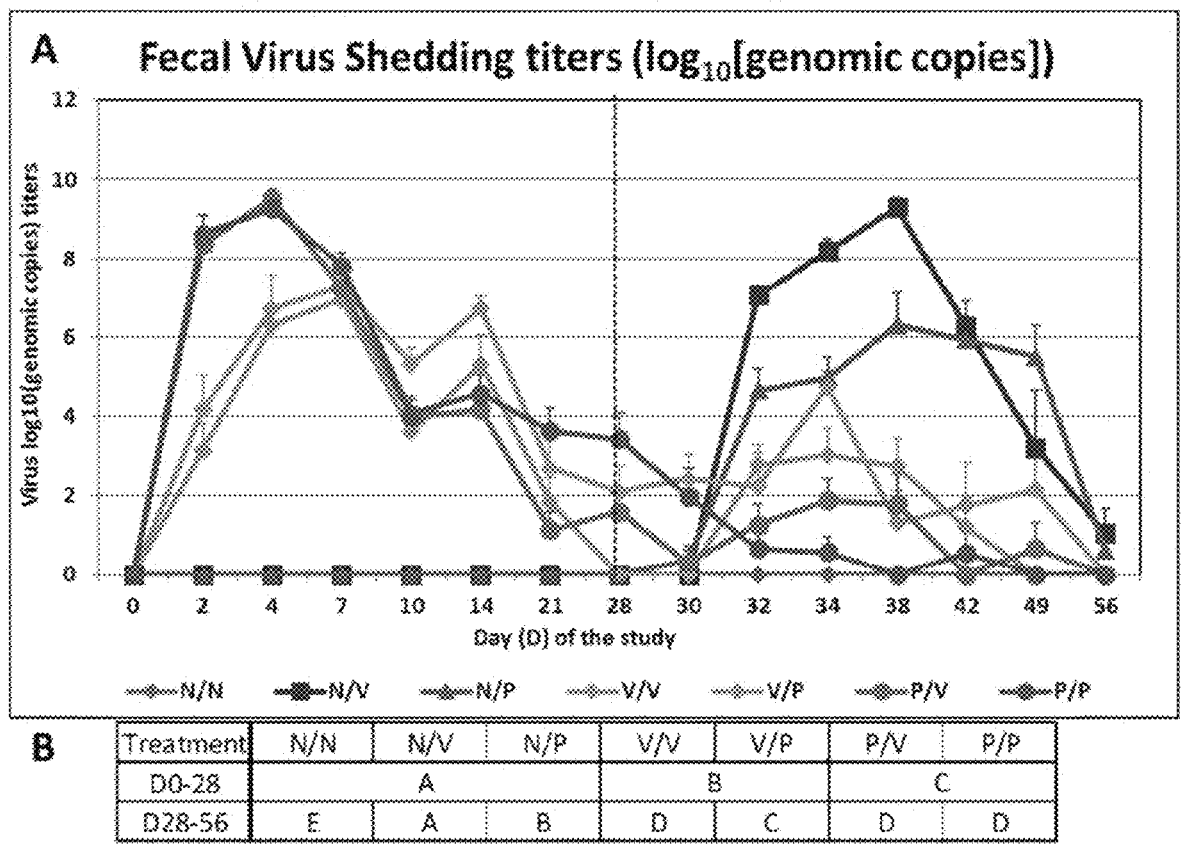

FIG. 28A-28B shows fecal virus shedding titers. FIG. 28A shows fecal virus shedding titers on each time point of each group with upper standard error bars shown. FIG. 28B shows statistic analysis of overall virus shedding titer in rectal swabs on D0-D28 and D28-D56. During D0-D28, the N/N, N/V and N/P groups received the same inoculum and were analyzed as the same treatment, similarly for the V/V and V/P groups, and P/V and P/P groups. Different letters indicate statistically significant difference in virus shedding amount between groups.

Figures 29A, 29B:
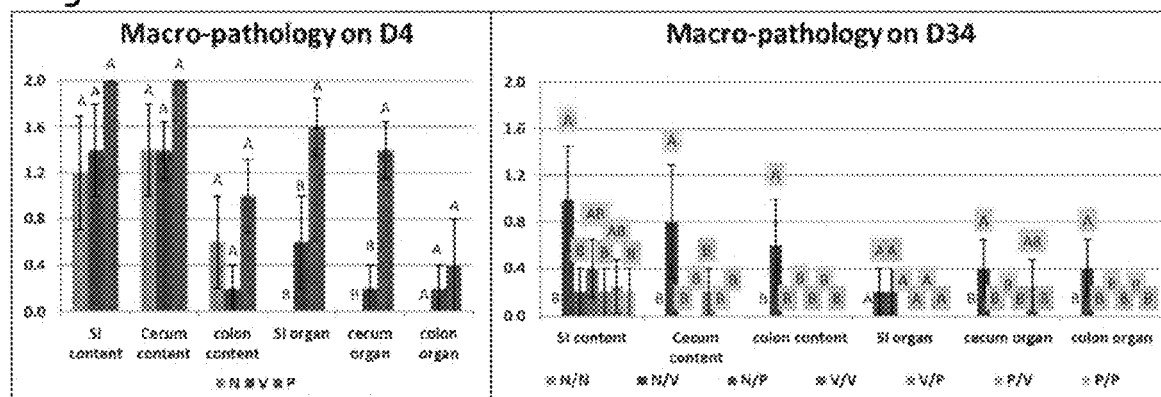

FIG. 29A-29B Macro-pathological scores, FIG. 29A is the group mean macro-pathological scores at D4 (4 days post the 1$^{st}$ inoculation) with the standard error bars shown. FIG. 29B is the group mean macro-pathological scores at D34 (6 days post the challenge at D28) with the standard error bars shown. Small intestine, cecum, and colon content scores as well as the gross lesion scores of small intestine, cecum and colon organs were shown. Different letters indicate statistically significant differences observed with the same parameter between groups. Yellow highlighted are statistics of V-strain challenged pigs, and green highlighted are statistics of P-strain challenged pigs.

Figures 30A, 30B:
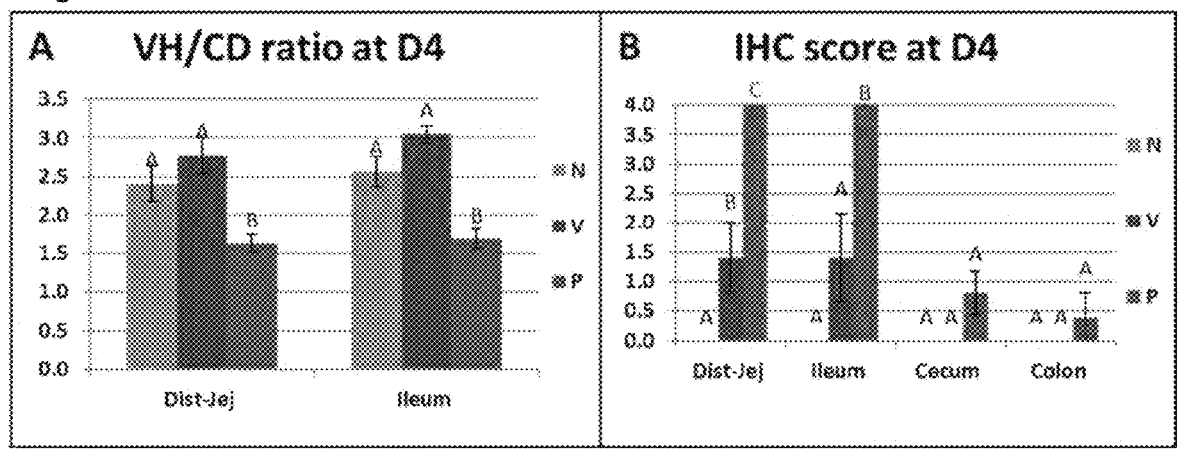

FIG. 30A-30B shows the histopathology measurement at D4. FIG. 30A shows the group mean of villus height/crypt depth ratios of distal jejunum and ileum with the standard error bars shown. FIG. 30B shows the group mean of PEDV IHC scores in distal jejunum, ileum, cecum, and colon with the standard error bars shown. Different letters indicate statistically significant differences observed in the same tissue between groups.

Figures 31A, 31B:
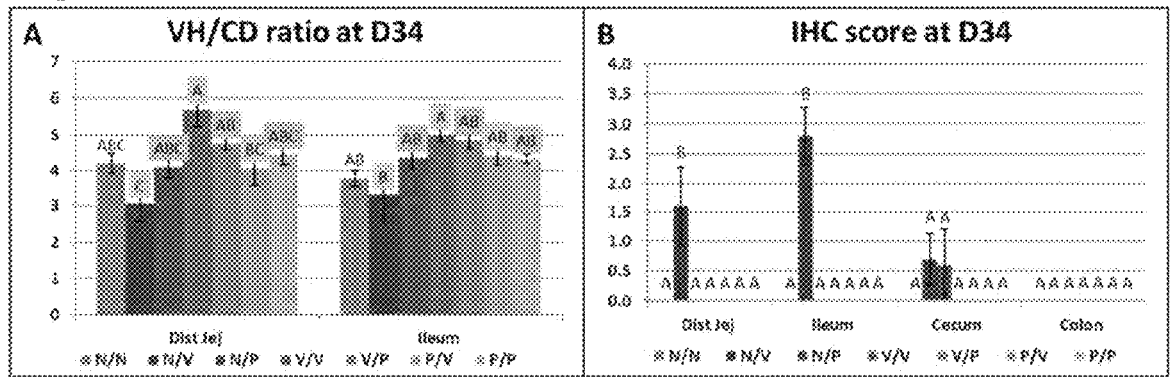

FIG. 31A-31B shows the histopathology measurement at D34. FIG. 31A show the group mean of villus height/crypt depth ratios of distal jejunum and ileum with the standard error bars shown. FIG. 31B shows the group mean of PEDV IHC scores in distal jejunum, ileum, cecum, and colon with the standard error bars shown. Different letters indicate statistically significant differences observed in the same tissue between groups. Yellow highlighted are statistics of V-strain challenged pigs, and green highlighted are statistics of P-strain challenged pigs.

Figures 32A, 32B:
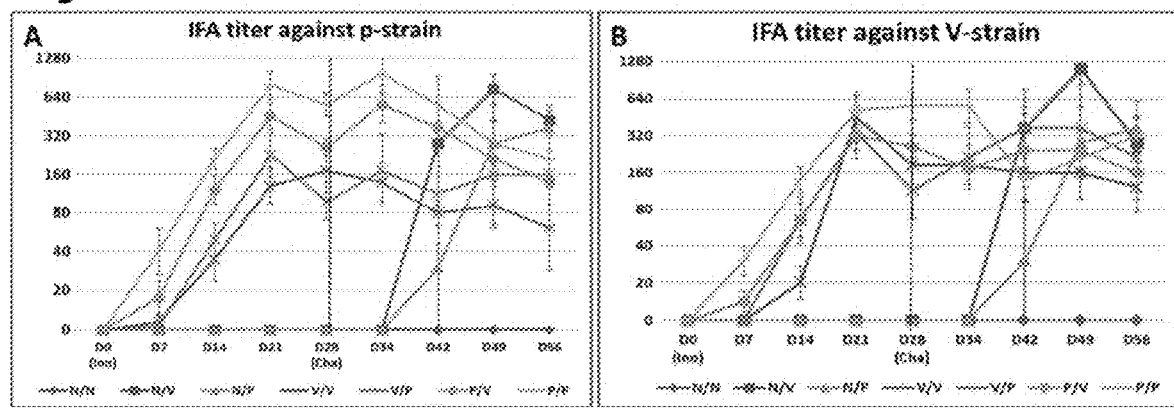

FIG. 32A-32B shows the serum IFA antibody titers against either P-strain virus or V-strain virus. FIG. 32A shows the group mean of serum IFA titers against P-strain virus with the standard error bars shown. FIG. 32B shows the group mean of serum IFA titers against V-strain virus with the standard error bars shown.

Figures 33A, 33B:
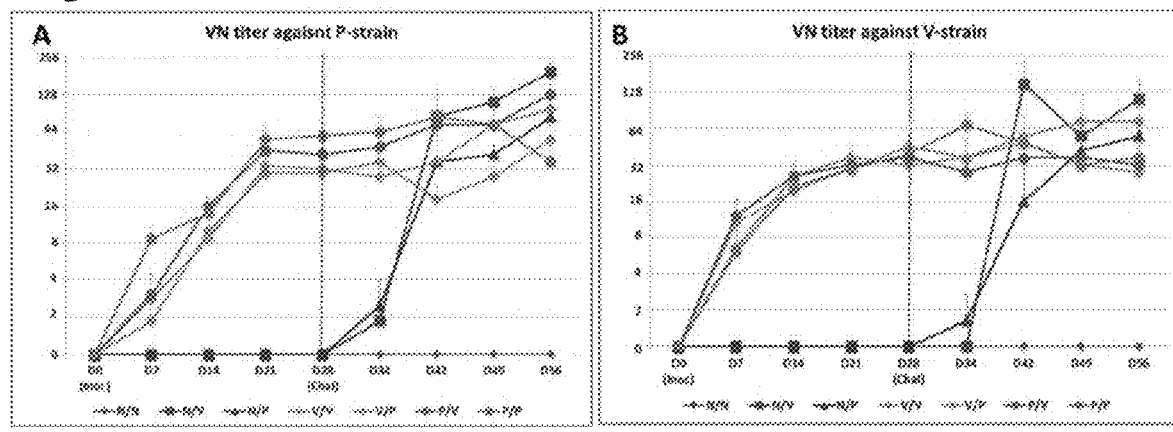

FIG. 33A-33B shows the serum VN antibody titers against either P-strain virus or V-strain virus. FIG. 33A shows the group mean of serum VN titers against P-strain virus with the standard error bars shown. FIG. 33B shows the group mean of serum VN titers against V-strain virus with the standard error bars shown.

Figure 34A:
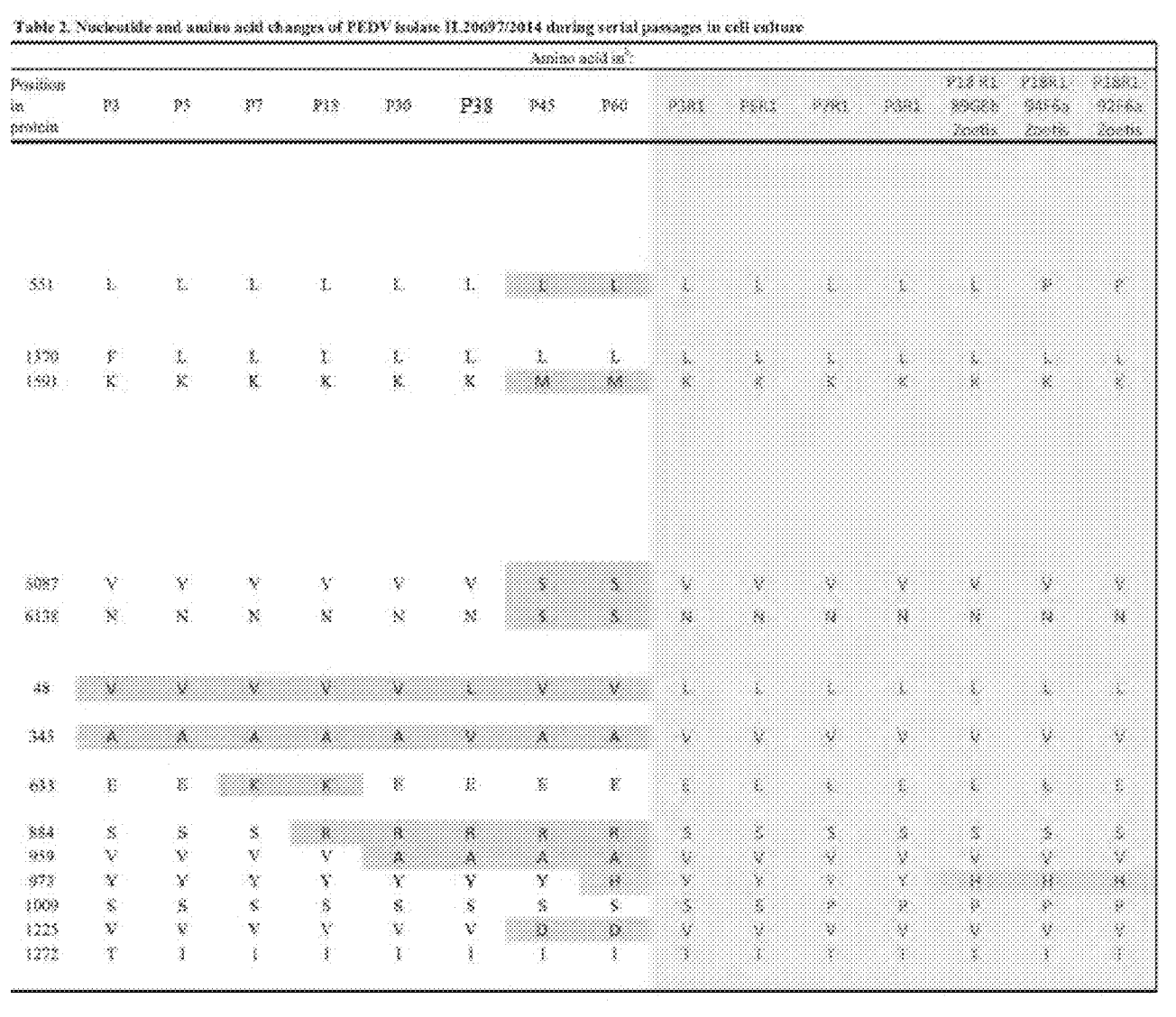

FIGS. 34A-34B show the nucleotide and amino acid changes of PEDV isolate IL20697/2014 during serial passages in cell culture.

DETAILED DESCRIPTION OF THE INVENTION

The following definitions and introductory matters are applicable in the specification.

The singular terms "a", "an", and "the" include plural referents unless context clearly indicates otherwise. Similarly, the word "or" is intended to include "and" unless the context clearly indicate otherwise. The word "or" means any one member of a particular list and also includes any combination of members of that list.

The term "adjuvant" refers to a compound that enhances the effectiveness of the vaccine, and may be added to the formulation that includes the immunizing agent. Adjuvants provide enhanced immune response even after administration of only a single dose of the vaccine. Adjuvants may include, for example, muramyl dipeptides, pyridine, aluminum hydroxide, dimethyldioctadecyl ammonium bromide (DDA), oils, oil-in-water emulsions, saponins, cytokines, and other substances known in the art. Examples of suitable adjuvants are described in U.S. Patent Application Publication No. US2004/0213817 A1. "Adjuvanted" refers to a composition that incorporates or is combined with an adjuvant.

"Antibodies" refers to polyclonal and monoclonal antibodies, chimeric, and single chain antibodies, as well as Fab fragments, including the products of a Fab or other immunoglobulin expression library. With respect to antibodies, the term, "immunologically specific" refers to antibodies that bind to one or more epitopes of a protein of interest, but which do not substantially recognize and bind other molecules in a sample containing a mixed population of antigenic biological molecules.

An "attenuated" PEDV as used herein refers to a PEDV which is capable of infecting and/or replicating in a susceptible host, but is non-pathogenic or less-pathogenic to the susceptible host. For example, the attenuated virus may cause no observable/detectable clinical manifestations, or less clinical manifestations, or less severe clinical manifestations, or exhibit a reduction in virus replication efficiency and/or infectivity, as compared with the related field isolated strains. The clinical manifestations of PEDV infection can include, without limitation, clinical diarrhea, vomiting, lethargy, loss of condition and dehydration.

An "epitope" is an antigenic determinant that is immunologically active in the sense that once administered to the host, it is able to evoke an immune response of the humoral (B cells) and/or cellular type (T cells). These are particular chemical groups or peptide sequences on a molecule that are antigenic. An antibody specifically binds a particular antigenic epitope on a polypeptide. In the animal most antigens will present several or even many antigenic determinants simultaneously. Such a polypeptide may also be qualified as an immunogenic polypeptide and the epitope may be identified as described further.

The term "immunogenic fragment" as used herein refers to a polypeptide or a fragment of a polypeptide, or a nucleotide sequence encoding the same which comprises an allele-specific motif, an epitope or other sequence such that the polypeptide or the fragment will bind an MHC molecule and induce a cytotoxic T lymphocyte ("CTL") response, and/or a B cell response (for example, antibody production), and/or T-helper lymphocyte response, and/or a delayed type hypersensitivity (DTH) response against the antigen from which the immunogenic polypeptide or the immunogenic fragment is derived. A DTH response is an immune reaction in which T cell-dependent macrophage activation and inflammation cause tissue injury. A DTH reaction to the subcutaneous injection of antigen is often used as an assay for cell-mediated immunity.

With the term "induction of an immunoprotective response" is meant a (humoral and/or cellular) immune response that reduces or eliminates one or more of the symptoms of disease, i.e. clinical signs, lesions, bacterial excretion and bacterial replication in tissues in the infected subject compared to a healthy control. Preferably said reduction in symptoms is statistically significant when compared to a control.

An "infectious DNA molecule", for purposes of the present invention, is a DNA molecule that encodes the necessary elements for viral replication, transcription, and translation into a functional virion in a suitable host cell.

The term "isolated" is used to indicate that a cell, peptide or nucleic acid is separated from its native environment. Isolated peptides and nucleic acids may be substantially pure, i.e. essentially free of other substances with which they may bound in nature.

For purposes of the present invention, the nucleotide sequence of a second polynucleotide molecule (either RNA or DNA) is "homologous" to the nucleotide sequence of a first polynucleotide molecule, or has "identity" to said first polynucleotide molecule, where the nucleotide sequence of the second polynucleotide molecule encodes the same polyaminoacid as the nucleotide sequence of the first polynucleotide molecule as based on the degeneracy of the genetic code, or when it encodes a polyaminoacid that is sufficiently similar to the polyaminoacid encoded by the nucleotide sequence of the first polynucleotide molecule so as to be useful in practicing the present invention. Homologous polynucleotide sequences also refers to sense and anti-sense strands, and in all cases to the complement of any such strands. For purposes of the present invention, a polynucleotide molecule is useful in practicing the present invention, and is therefore homologous or has identity, where it can be used as a diagnostic probe to detect the presence of PEDV or viral polynucleotide in a fluid or tissue sample of an infected pig, e.g. by standard hybridization or amplification techniques. Generally, the nucleotide sequence of a second polynucleotide molecule is homologous to the nucleotide sequence of a first polynucleotide molecule if it has at least about 70% nucleotide sequence identity to the nucleotide sequence of the first polynucleotide molecule as based on the BLASTN algorithm (National Center for Biotechnology Information, otherwise known as NCBI, (Bethesda, Md., USA) of the United States National Institute of Health). In a specific example for calculations according to the practice of the present invention, reference is made to BLASTP 2.2.6 [Tatusova TA and TL Madden, "BLAST 2 sequences—a new tool for comparing protein and nucleotide sequences." (1999) FEMS Microbiol Lett. 174:247-250.]. Briefly, two amino acid sequences are aligned to optimize the alignment scores using a gap opening penalty of 10, a gap extension penalty of 0.1, and the "blosum62" scoring matrix of Henikoff and Henikoff (Proc. Nat. Acad. Sci. USA 325 89:10915-10919. 1992). The percent identity is then calculated as: Total number of identical matches X 100/divided by the length of the longer sequence+number of gaps introduced into the longer sequence to align the two sequences.

Preferably, a homologous nucleotide sequence has at least about 75% nucleotide sequence identity, even more preferably at least about 80%, 85%, 90% and 95% nucleotide sequence identity. Since the genetic code is degenerate, a homologous nucleotide sequence can include any number of "silent" base changes, i.e. nucleotide substitutions that nonetheless encode the same amino acid.

A homologous nucleotide sequence can further contain non-silent mutations, i.e. base substitutions, deletions, or additions resulting in amino acid differences in the encoded polyaminoacid, so long as the sequence remains at least about 70% identical to the polyaminoacid encoded by the first nucleotide sequence or otherwise is useful for practicing the present invention. In this regard, certain conservative amino acid substitutions may be made which are generally recognized not to inactivate overall protein function: such as in regard of positively charged amino acids (and vice versa), lysine, arginine and histidine; in regard of negatively charged amino acids (and vice versa), aspartic acid and glutamic acid; and in regard of certain groups of neutrally charged amino acids (and in all cases, also vice versa), (1) alanine and serine, (2) asparagine, glutamine, and histidine, (3) cysteine and serine, (4) glycine and proline, (5) isoleucine, leucine and valine, (6) methionine, leucine and isoleucine, (7) phenylalanine, methionine, leucine, and tyrosine, (8) serine and threonine, (9) tryptophan and tyrosine, (10) and for example tyrosine, tyrptophan and phenylalanine. Amino acids can be classified according to physical properties and contribution to secondary and tertiary protein structure. A conservative substitution is thus recognized in the art as a substitution of one amino acid for another amino acid that has similar properties, and exemplary conservative substitutions may be found in WO 97/09433, page 10, published Mar. 13, 1997 (PCT/GB96/02197, filed Sep. 6, 1996. Alternatively, conservative amino acids can be grouped as described in Lehninger, (Biochemistry, Second Edition; Worth Publishers, Inc. NY:NY (1975), pp. 71-77). Protein sequences can be aligned using both Vector NTI Advance 11.5 and CLUSTAL 2.1 multiple sequence alignment. As used herein the recitation of a particular amino acid or nucleotide sequence shall include all silent mutations with respect to nucleic acid sequence and any and all conservatively modified variants with respect to amino acid sequences.

Homologous nucleotide sequences can be determined by comparison of nucleotide sequences, for example by using BLASTN, above. Alternatively, homologous nucleotide sequences can be determined by hybridization under selected conditions. For example, the nucleotide sequence of a second polynucleotide molecule is homologous to SEQ ID NO:1 (or any other particular polynucleotide sequence) if it hybridizes to the complement of SEQ ID NO:1 under moderately stringent conditions, e.g., hybridization to filter-bound DNA in 0.5 M $NaHPO_4$, 7% sodium dodecyl sulfate (SDS), 1 mM EDTA at 65° C., and washing in 0.2×SSC/ 0.1% SDS at 42° C. (see Ausubel et al editors, Protocols in Molecular Biology, Wiley and Sons, 1994, pp. 6.0.3 to 6.4.10), or conditions which will otherwise result in hybridization of sequences that encode a PEDV virus as defined below. Modifications in hybridization conditions can be empirically determined or precisely calculated based on the length and percentage of guanosine/cytosine (GC) base pairing of the probe. The hybridization conditions can be calculated as described in Sambrook, et al., (Eds.), Molecular Cloning: A Laboratory Manual, Cold Spring Harbor Laboratory Press: Cold Spring Harbor, N.Y. (1989), pp. 9.47 to 9.51.

In another embodiment, a second nucleotide sequence is homologous to SEQ ID NO: 1 (or any other sequence of the invention) if it hybridizes to the complement of SEQ ID NO: 1 under highly stringent conditions, e.g. hybridization to filter-bound DNA in 0.5 M $NaHPO_4$, 7% SDS, 1 mM EDTA at 65° C., and washing in 0.1×SSC/0.1% SDS at 68° C., as is known in the art.

It is furthermore to be understood that the isolated polynucleotide molecules and the isolated RNA molecules of the present invention include both synthetic molecules and molecules obtained through recombinant techniques, such as by in vitro cloning and transcription.

It should be noted that many of the vaccine-capable attenuated PEDV viruses of the present invention contain substantial deletions of ORF3 protein, resulting from attenuating mutations in the ORF3 nucleotide sequence, that cause substantial internal deletions and/or most typically the appearance of truncated translation resultant from frame-shifting and the appearance of stop codons. It should therefore be noted that within the practice of the present invention, alignment and percent identity calculations and stated identity results (whether or nucleotide or amino acid sequences) can be calculated with or without reference to deleted ORF3 sequences.

"Mammals" include any warm-blooded vertebrates of the Mammalia class, including humans.

A "pharmaceutically acceptable carrier" means any conventional pharmaceutically acceptable carrier, vehicle, or excipient that is used in the art for production and administration of vaccines. Pharmaceutically acceptable carriers are typically non-toxic, inert, solid or liquid carriers.

The terms "porcine" and "swine" are used interchangeably herein and refer to any animal that is a member of the family Suidae such as, for example, a pig.

A "susceptible" host as used herein refers to a cell or an animal that can be infected by PEDV. When introduced to a susceptible animal, an attenuated PEDV may also induce an immunological response against the PEDV or its antigen, and thereby render the animal immunity against PEDV infection.

The term "vaccine" refers to an antigenic preparation used to produce immunity to a disease, in order to prevent or ameliorate the effects of infection. Vaccines are typically prepared using a combination of an immunologically effective amount of an immunogen together with an adjuvant effective for enhancing the immune response of the vaccinated subject against the immunogen.

Vaccine formulations will contain a "therapeutically effective amount" of the active ingredient, that is, an amount capable of eliciting an induction of an immunoprotective response in a subject to which the composition is administered. In the treatment and prevention of PEDV disease, for example, a "therapeutically effective amount" would preferably be an amount that enhances resistance of the vaccinated subject to new infection and/or reduces the clinical severity of the disease. Such protection will be demonstrated by either a reduction or lack of symptoms normally displayed by a subject infected with PEDV, a quicker recovery time and/or a lowered count of virus particles. Vaccines can be administered prior to infection, as a preventative measure against PEDV. Alternatively, vaccines can be administered after the subject already has contracted a disease. Vaccines given after exposure to PEDV may be able to attenuate the disease, triggering a superior immune response than the natural infection itself.

For the purpose of the practice of all aspects of the invention, it is well known to those skilled in the art that there is no absolute immunological boundary in immunological assays in regard of animals that are seronegative for exposure to a particular antigen or pathogen, and those that are seropositive (having been exposed to a vaccine or pathogen). Nonetheless, those skilled in the art would recognize that in serum neutralization assays, seropositive animals would generally be detected at least up to a 1:1000 serum dilution, whereas a seronegative animal would be expected not to neutralize at a higher dilution that about 1:20 or 1:10.

Vaccine Formulations/Immunogenic Compositions

The invention also relates to an immunogenic composition, suitable to be used as a vaccine, which comprises a variant PEDV strain according to the invention. The immunogenic compositions according to the invention elicit a specific humoral immune response toward the PEDV comprising neutralizing antibodies.

The preferred immunogenic compositions based upon the variant strains disclosed herein can provide live, attenuated viruses which exhibit high immunogenicity while at the same time not producing dangerous pathogenic or lethal effects.

The immunogenic compositions of this invention are not, however, restricted to any particular type or method of preparation. These include, but are not limited to, infectious DNA vaccines (i.e., using plasmids, vectors or other conventional carriers to directly inject DNA into pigs), live vaccines, modified live vaccines, inactivated vaccines, subunit vaccines, attenuated vaccines, genetically engineered vaccines, etc. These vaccines are prepared by standard methods known in the art.

The present invention preferably includes vaccine compositions comprising a live, attenuated variant PEDV of the invention and a pharmaceutically acceptable carrier. As used herein, the expression "live, attenuated PEDV of the invention" encompasses any live, attenuated PEDV strain that includes one or more of the variations described herein. The pharmaceutically acceptable carrier can be, e.g., water, a stabilizer, a preservative, culture medium, or a buffer. Vaccine formulations comprising the attenuated PEDV of the invention can be prepared in the form of a suspension or in a lyophilized form or, alternatively, in a frozen form. If frozen, glycerol or other similar agents may be added to enhance stability when frozen. The advantages of live attenuated vaccines, in general, include the presentation of all the relevant immunogenic determinants of an infectious agent in its natural form to the host's immune system, and the need for relatively small amounts of the immunizing agent due to the ability of the agent to multiply in the vaccinated host.

Attenuation of the virus for a live vaccine, so that it is insufficiently pathogenic to substantially harm the vaccinated target animal, may be accomplished by known procedures, including preferably by serial passaging. The following references provide various general methods for attenuation of coronaviruses, and are suitable for attenuation or further attenuation of any of the strains useful in the practice of the present invention: B. Neuman et al., Journal of Virology, vol. 79, No. 15, pp. 9665-9676, 2005; J. Netland et al., Virology, v 399(1), pp. 120-128, 2010; Y-P Huang et al., "Sequence changes of infectious bronchitis virus isolates in the 3' 7.3 kb of the genome after attenuating passage in embryonated eggs, Avian Pathology, v. 36 (1), (Abstract), 2007; and S. Hingley et al., Virology, v. 200(1) 1994, pp. 1-10; see U.S. Pat. No. 3,914,408; and Ortego et al., Virology, vol. 308 (1), pp. 13-22, 2003.

Additional genetically engineered vaccines, which are desirable in the present invention, are produced by techniques known in the art. Such techniques involve, but are not limited to, further manipulation of recombinant DNA, modification of or substitutions to the amino acid sequences of the recombinant proteins and the like.

Genetically engineered vaccines based on recombinant DNA technology are made, for instance, by identifying alternative portions of the viral gene encoding proteins responsible for inducing a stronger immune or protective response in pigs (e.g., proteins derived from M, GP2, GP3, GP4, or GP5, etc.). Various subtypes or isolates of the viral protein genes can be subjected to the DNA-shuffling method. The resulting heterogeneous chimeric viral proteins can be used broad protecting subunit vaccines. Alternatively, such chimeric viral genes or immuno-dominant fragments can be cloned into standard protein expression vectors, such as the baculovirus vector, and used to infect appropriate host cells (see, for example, O'Reilly et al., "Baculovirus Expression Vectors: A Lab Manual," Freeman & Co., 1992). The host cells are cultured, thus expressing the desired vaccine proteins, which can be purified to the desired extent and formulated into a suitable vaccine product.

If the clones retain any undesirable natural abilities of causing disease, it is also possible to pinpoint the nucleotide sequences in the viral genome responsible for any residual virulence, and genetically engineer the virus avirulent through, for example, site-directed mutagenesis. Site-directed mutagenesis is able to add, delete or change one or more nucleotides (see, for instance, Zoller et al., DNA 3:479-488, 1984). An oligonucleotide is synthesized containing the desired mutation and annealed to a portion of single stranded viral DNA. The hybrid molecule, which results from that procedure, is employed to transform bacteria. Then double-stranded DNA, which is isolated containing the appropriate mutation, is used to produce full-length DNA by ligation to a restriction fragment of the latter that is subsequently transfected into a suitable cell culture. Ligation of the genome into the suitable vector for transfer may be accomplished through any standard technique known to those of ordinary skill in the art. Transfection of the vector into host cells for the production of viral progeny may be done using any of the conventional methods such as calcium-phosphate or DEAE-dextran mediated transfection, electroporation, protoplast fusion and other well-known techniques (e.g., Sambrook et al., "Molecular Cloning: A Laboratory Manual," Cold Spring Harbor Laboratory Press, 1989). The cloned virus then exhibits the desired mutation. Alternatively, two oligonucleotides can be synthesized which contain the appropriate mutation. These may be annealed to form double-stranded DNA that can be inserted in the viral DNA to produce full-length DNA.

An immunologically effective amount of the vaccines of the present invention is administered to a pig in need of protection against viral infection. The immunologically effective amount or the immunogenic amount that inoculates the pig can be easily determined or readily titrated by routine testing. An effective amount is one in which a sufficient immunological response to the vaccine is attained to protect the pig exposed to the PEDV virus. Preferably, the pig is protected to an extent in which one to all of the adverse physiological symptoms or effects of the viral disease are significantly reduced, ameliorated or totally prevented.

Vaccines of the present invention can be formulated following accepted convention to include acceptable carriers for animals, such as standard buffers, stabilizers, diluents, preservatives, and/or solubilizers, and can also be formulated to facilitate sustained release. Diluents include water, saline, dextrose, ethanol, glycerol, and the like. Additives for isotonicity include sodium chloride, dextrose, mannitol, sorbitol, and lactose, among others. Stabilizers include albumin, among others. Other suitable vaccine vehicles and additives, including those that are particularly useful in formulating modified live vaccines, are known or will be apparent to those skilled in the art. See, e.g., Remington's Pharmaceutical Science, 18th ed., 1990, Mack Publishing, which is incorporated herein by reference.

Vaccines of the present invention may further comprise one or more additional immunomodulatory components such as, e.g., an adjuvant or cytokine, among others. Non-limiting examples of adjuvants that can be used in the vaccine of the present invention include the RIBI adjuvant system (Ribi Inc., Hamilton, Mont.), alum, mineral gels such as aluminum hydroxide gel, oil-in-water emulsions, water-in-oil emulsions such as, e.g., Freund's complete and incomplete adjuvants, Block copolymer (CytRx, Atlanta Ga.), QS-21 (Cambridge Biotech Inc., Cambridge Mass.), SAF-M (Chiron, Emeryville Calif.), AMPHIGEN® adjuvant, saponin, Quil A or other saponin fraction, monophosphoryl lipid A, ionic polysaccharides, and Avridine lipid-amine adjuvant. Non-limiting examples of oil-in-water emulsions useful in the vaccine of the invention include modified SEAM62 and SEAM 1/2 formulations. Modified SEAM62 is an oil-in-water emulsion containing 5% (v/v) squalene (Sigma), 1% (v/v) SPAN® 85 detergent (ICI Surfactants), 0.7% (v/v) TWEEN® 80 detergent (ICI Surfactants), 2.5% (v/v) ethanol, 200 µg/ml Quil A, 100 mg/ml cholesterol, and 0.5% (v/v) lecithin. Modified SEAM 1/2 is an oil-in-water emulsion comprising 5% (v/v) squalene, 1% (v/v) SPAN® 85 detergent, 0.7% (v/v) Tween 80 detergent, 2.5% (v/v) ethanol, 100 mg/ml Quil A, and 50 mg/ml cholesterol. Other immunomodulatory agents that can be included in the vaccine include, e.g., one or more interleukins, interferons, or other known cytokines.

Additional adjuvant systems permit for the combination of both T-helper and B-cell epitopes, resulting in one or more types of covalent T-B epitope linked structures, with may be additionally lipidated, such as those described in WO2006/084319, WO2004/014957, and WO2004/014956.

In a preferred embodiment of the present invention, ORFI PEDV protein, or other PEDV proteins or fragments thereof, is formulated with 5% AMPHIGEN® as discussed hereinafter.

Adjuvant Components

The vaccine compositions of the invention may or may not include adjuvants. In particular, as based on an orally infective virus, the modified live vaccines of the invention may be used adjuvant free, with a sterile carrier. Adjuvants that may be used for oral administration include those based on CT-like immune modulators (rmLT, CT-B, i.e. recombinant-mutant heat labile toxin of *E. coli*, Cholera toxin-B subunit); or via encapsulation with polymers and alginates, or with mucoadhesives such as chitosan, or via liposomes. A preferred adjuvanted or non adjuvanted vaccine dose at the minimal protective dose through vaccine release may provide between approximately 10 and approximately $10^6$ $\log_{10}TCID_{50}$ of virus per dose, or higher. "TCID50" refers to "tissue culture infective dose" and is defined as that dilution of a virus required to infect 50% of a given batch of inoculated cell cultures. Various methods may be used to calculate TCID50, including the Spearman-Karber method which is utilized throughout this specification. For a description of the Spearman-Karber method, see B. W. Mahy & H. O. Kangro, Virology Methods Manual, p. 25-46 (1996). Adjuvants, if present, may be provided as emulsions, more commonly if non-oral administration is selected, but should not decrease starting titer by more than 0.7 logs (80% reduction).

In one example, adjuvant components are provided from a combination of lecithin in light mineral oil, and also an aluminum hydroxide component. Details concerning the composition and formulation of Amphigen® (as representative lecithin/mineral oil component) are as follows.

A preferred adjuvanted may be provided as a 2 ML dose in a buffered solution further comprising about 5% (v/v) Rehydragel® (aluminum hydroxide gel) and "20% Amphigen"® at about 25% final (v/v). Amphigen® is generally described in U.S. Pat. No. 5,084,269 and provides de-oiled lecithin (preferably soy) dissolved in a light oil, which is then dispersed into an aqueous solution or suspension of the antigen as an oil-in-water emulsion. Amphigen has been improved according to the protocols of U.S. Pat. No. 6,814, 971 (see columns 8-9 thereof) to provide a so-called "20% Amphigen" component for use in the final adjuvanted vaccine compositions of the present invention. Thus, a stock mixture of 10% lecithin and 90% carrier oil (DRAKEOL®, Penreco, Karns City, Pa.) is diluted 1:4 with 0.63% phosphate buffered saline solution, thereby reducing the lecithin and DRAKEOL components to 2% and 18% respectively (i.e. 20% of their original concentrations). Tween 80 and Span 80 surfactants are added to the composition, with representative and preferable final amounts being 5.6% (v/v) Tween 80 and 2.4% (v/v) Span 80, wherein the Span is originally provided in the stock DRAKEOL component, and the Tween is originally provided from the buffered saline component, so that mixture of the saline and DRAKEOL components results in the finally desired surfactant concentrations. Mixture of the DRAKEOL/lecithin and saline solutions can be accomplished using an In-Line Slim Emulsifier apparatus, model 405, Charles Ross and Son, Hauppauge, N.Y., USA.

The vaccine composition also includes Rehydragel® LV (about 2% aluminum hydroxide content in the stock material), as additional adjuvant component (available from Reheis, N.J., USA, and ChemTrade Logistics, USA). With further dilution using 0.63% PBS, the final vaccine composition contains the following compositional amounts per 2 ML dose; 5% (v/v) Rehydragel® LV; 25% (v/v) of "20% Amphigen", i.e. it is further 4-fold diluted); and 0.01% (w/v) of merthiolate.

As is understood in the art, the order of addition of components can be varied to provide the equivalent final vaccine composition. For example, an appropriate dilution of virus in buffer can be prepared. An appropriate amount of Rehydragel® LV (about 2% aluminum hydroxide content) stock solution can then be added, with blending, in order to permit the desired 5% (v/v) concentration of Rehydragel® LV in the actual final product. Once prepared, this intermediate stock material is combined with an appropriate amount of "20% Amphigen" stock (as generally described above, and already containing necessary amounts of Tween 80 and Span 80) to again achieve a final product having 25% (v/v) of "20% Amphigen". An appropriate amount of 10% merthiolate can finally be added.

The vaccinate compositions of the invention permit variation in all of the ingredients, such that the total dose of antigen may be varied preferably by a factor of 100 (up or down) compared to the antigen dose stated above, and most preferably by a factor of 10 or less (up or down). Similarly, surfactant concentrations (whether Tween or Span) may be varied by up to a factor of 10, independently of each other, or they may be deleted entirely, with replacement by appropriate concentrations of similar materials, as is well understood in the art.

Rehydragel® concentrations in the final product may be varied, first by the use of equivalent materials available from many other manufacturers (i.e. Alhydrogel®, Brenntag; Denmark), or by use of additional variations in the Rehydragel® line of products such as CG, HPA or HS. Using LV as an example, final useful concentrations thereof including from 0% to 20%, with 2-12% being more preferred, and 4-8% being most preferred, Similarly, the although the final concentration of Amphigen (expressed as % of "20% Amphigen") is preferably 25%, this amount may vary from 5-50%, preferably 20-30% and is most preferably about 24-26%.

According to the practice of the invention, the oil used in the adjuvant formulations of the instant invention is preferably a mineral oil. As used herein, the term "mineral oil" refers to a mixture of liquid hydrocarbons obtained from petrolatum via a distillation technique. The term is synonymous with "liquefied paraffin", "liquid petrolatum" and "white mineral oil." The term is also intended to include "light mineral oil," i.e., oil which is similarly obtained by distillation of petrolatum, but which has a slightly lower specific gravity than white mineral oil. See, e.g., Remington's Pharmaceutical Sciences, 18th Edition (Easton, Pa.: Mack Publishing Company, 1990, at pages 788 and 1323). Mineral oil can be obtained from various commercial sources, for example, J. T. Baker (Phillipsburg, Pa.), USB Corporation (Cleveland, Ohio). Preferred mineral oil is light mineral oil commercially available under the name DRAKEOL®.

Typically, the oily phase is present in an amount from 50% to 95% by volume; preferably, in an amount of greater than 50% to 85%; more preferably, in an amount from greater than 50% to 60%, and more preferably in the amount of greater than 50-52% v/v of the vaccine composition. The oily phase includes oil and emulsifiers (e.g., SPAN® 80, TWEEN® 80 etc), if any such emulsifiers are present.

Non-natural, synthetic emulsifiers suitable for use in the adjuvant formulations of the present invention also include sorbitan-based non-ionic surfactants, e.g. fatty-acid-substituted sorbitan surfactants (commercially available under the name SPAN® or ARLACEL®), fatty acid esters of polyethoxylated sorbitol (TWEEN®), polyethylene glycol esters of fatty acids from sources such as castor oil (EMULFOR®); polyethoxylated fatty acid (e.g., stearic acid available under the name SIMULSOL® M-53), polyethoxylated isooctylphenol/formaldehyde polymer (TYLOXAPOL®), polyoxyethylene fatty alcohol ethers (BRIJ®); polyoxyethylene nonphenyl ethers (TRITON® N), polyoxyethylene isooctylphenyl ethers (TRITON® X). Preferred synthetic surfactants are the surfactants available under the name SPAN® and TWEEN®, such as TWEEN®-80 (Polyoxyethylene (20) sorbitan monooleate) and SPAN®-80 (sorbitan monooleate). Generally speaking, the emulsifier(s) may be present in the vaccine composition in an amount of 0.01% to 40% by volume, preferably, 0.1% to 15%, more preferably 2% to 10%.

In an alternative embodiment of the invention, the final vaccine composition contains SP-Oil® and Rehydragel® LV as adjuvants (or other Rehydragel® or Alhydrogel® products), with preferable amounts being about 5-20% SP-Oil (v/v) and about 5-15% Rehydragel LV (v/v), and with 5% and 12%, respectively, being most preferred amounts. In this regard it is understood that % Rehydragel refers to percent dilution from the stock commercial product. (SP-Oil® is a fluidized oil emulsion with includes a polyoxyethylene-polyoxypropylene block copolymer (Pluronic® L121, BASF Corporation, squalene, polyoxyethylene sorbitan monooleate (Tween®80, ICI Americas) and a buffered salt solution.)

It should be noted that the present invention may also be successfully practiced using wherein the adjuvant component is only Amphigen®.

In another embodiment of the invention, the final vaccine composition contains TXO as an adjuvant; TXO is generally described in WO 2015/042369. All TXO compositions disclosed therein are useful in the preparation of vaccines of the invention. In TXO, the immunostimulatory oligonucleotide ("T"), preferably an ODN, preferably containing a palindromic sequence, and optionally with a modified backbone, is present in the amount of 0.1 to 5 ug per 50 ul of the vaccine composition (e.g., 0.5-3 ug per 50 ul of the composition, or more preferably 0.09-0.11 ug per 50 ul of the composition). A preferred species thereof is SEQ ID NO: 8 as listed (page 17) in the WO2015/042369 publication (PCT/US2014/056512). The polycationic carrier ("X") is present in the amount of 1-20 ug per 50 ul (e.g., 3-10 ug per 50 ul, or about 5 ug per 50 ul). Light mineral oil ("O") is also a component of the TXO adjuvant.

In certain embodiments, TXO adjuvants are prepared as follows:
a) Sorbitan monooleate, MPL-A and cholesterol are dissolved in light mineral oil. The resulting oil solution is sterile filtered;
b) The immunostimulatory oligonucleotide, Dextran DEAE and Polyoxyethylene (20) sorbitan monooleate are dissolved in aqueous phase, thus forming the aqueous solution; and
c) The aqueous solution is added to the oil solution under continuous homogenization thus forming the adjuvant formulation TXO.

All the adjuvant compositions of the invention can be used with any of the PEDV strains and isolates covered by the present Specification.

Additional adjuvants useful in the practice of the invention include Prezent-A (see generally United States published patent application US20070298053; and "QCDCRT" or "QCDC"-type adjuvants (see generally United States published patent application US20090324641.

Excipients

The immunogenic and vaccine compositions of the invention can further comprise pharmaceutically acceptable carriers, excipients and/or stabilizers (see e.g. Remington: The Science and practice of Pharmacy, 2005, Lippincott Williams), in the form of lyophilized formulations or aqueous solutions. Acceptable carriers, excipients, or stabilizers are nontoxic to recipients at the dosages and concentrations, and may comprise buffers such as phosphate, citrate, and other organic acids; antioxidants including ascorbic acid and methionine; preservatives (such as Mercury((o-carboxyphenyl)thio)ethyl sodium salt (THIOMERSAL), octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrans; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG), TWEEN or PLURONICS.

Vaccines of the present invention can optionally be formulated for sustained release of the virus, infectious DNA molecule, plasmid, or viral vector of the present invention. Examples of such sustained release formulations include virus, infectious DNA molecule, plasmid, or viral vector in combination with composites of biocompatible polymers, such as, e.g., poly (lactic acid), poly (lactic-co-glycolic acid), methylcellulose, hyaluronic acid, collagen and the like. The structure, selection and use of degradable polymers in drug delivery vehicles have been reviewed in several publications, including A. Domb et al., 1992, Polymers for Advanced Technologies 3: 279-292, which is incorporated herein by reference. Additional guidance in selecting and using polymers in pharmaceutical formulations can be found in texts known in the art, for example M. Chasin and R. Langer (eds), 1990, "Biodegradable Polymers as Drug Delivery Systems" in: Drugs and the Pharmaceutical Sciences, Vol. 45, M. Dekker, N.Y., which is also incorporated herein by reference. Alternatively, or additionally, the virus, plasmid, or viral vector can be microencapsulated to improve administration and efficacy. Methods for microencapsulating antigens are well-known in the art, and include techniques described, e.g., in U.S. Pat. Nos. 3,137,631; 3,959,457; 4,205,060; 4,606,940; 4,744,933; 5,132,117; and International Patent Publication WO 95/28227, all of which are incorporated herein by reference.

Liposomes can also be used to provide for the sustained release of virus, plasmid, viral protein, or viral vector. Details concerning how to make and use liposomal formulations can be found in, among other places, U.S. Pat. Nos. 4,016,100; 4,452,747; 4,921,706; 4,927,637; 4,944,948; 5,008,050; and 5,009,956, all of which are incorporated herein by reference.

An effective amount of any of the above-described vaccines can be determined by conventional means, starting with a low dose of virus, viral protein plasmid or viral vector, and then increasing the dosage while monitoring the effects. An effective amount may be obtained after a single administration of a vaccine or after multiple administrations of a vaccine. Known factors can be taken into consideration when determining an optimal dose per animal. These include the species, size, age and general condition of the animal, the presence of other drugs in the animal, and the like. The actual dosage is preferably chosen after consideration of the results from other animal studies.

One method of detecting whether an adequate immune response has been achieved is to determine seroconversion and antibody titer in the animal after vaccination. The timing of vaccination and the number of boosters, if any, will preferably be determined by a doctor or veterinarian based on analysis of all relevant factors, some of which are described above.

The effective dose amount of virus, protein, infectious nucleotide molecule, plasmid, or viral vector, of the present invention can be determined using known techniques, taking into account factors that can be determined by one of ordinary skill in the art such as the weight of the animal to be vaccinated. The dose amount of virus of the present invention in a vaccine of the present invention preferably ranges from about $10^1$ to about $10^9$ pfu (plaque forming units), more preferably from about $10^2$ to about $10^8$ pfu, and most preferably from about $10^3$ to about 107 pfu. The dose amount of a plasmid of the present invention in a vaccine of the present invention preferably ranges from about 0.1 µg to about 100 mg, more preferably from about 1 µg to about 10 mg, even more preferably from about 10 µg to about 1 mg. The dose amount of an infectious DNA molecule of the present invention in a vaccine of the present invention preferably ranges from about 0.1 µg to about 100 mg, more preferably from about 1 µg to about 10 mg, even more preferably from about 10 µg to about 1 mg. The dose amount of a viral vector of the present invention in a vaccine of the present invention preferably ranges from about $10^1$ pfu to about $10^9$ pfu, more preferably from about $10^2$ pfu to about $10^8$ pfu, and even more preferably from about $10^3$ to about $10^7$ pfu. A suitable dosage size ranges from about 0.5 ml to about 10 ml, and more preferably from about 1 ml to about 5 ml.

Suitable doses for viral protein or peptide vaccines according to the practice of the present invention range generally from 1 to 50 micrograms per dose, or higher amounts as may be determined by standard methods, with the amount of adjuvant to be determined by recognized methods in regard of each such substance. In a preferred example of the invention relating to vaccination of swine, an optimum age target for the animals is between about 1 and 21 days, which at pre-weening, may also correspond with other scheduled vaccinations such as against *Mycoplasma hyopneumoniae*. Additionally, a preferred schedule of vaccination for breeding sows would include similar doses, with an annual revaccination schedule.

Dosing

A preferred clinical indication is for treatment, control and prevention in both breeding sows and gilts pre-farrowing, followed by vaccination of piglets. In a representative example (applicable to both sows and gilts), two 2-ML doses of vaccine will be used, although of course, actual volume of the dose is a function of how the vaccine is formulated, with actual dosing amounts ranging from 0.1 to 5 ML, taking also into account the size of the animals. Single dose vaccination is also appropriate.

The first dose may be administered as early as pre-breeding to 5-weeks pre-farrowing, with the second dose administered preferably at about 1-3 weeks pre-farrowing. Doses vaccine preferably provide an amount of viral material that corresponds to a $TCID_{50}$ (tissue culture infective dose) of between about $10^6$ and $10^8$, more preferably between about $10^7$ and $10^{7.5}$, and can be further varied, as is recognized in the art. Booster doses can be given two to four weeks prior to any subsequent farrowings. Intramuscular vaccination (all doses) is preferred, although one or more of the doses could be given subcutaneously. Oral administration is also preferred. Vaccination may also be effective in naïve animals, and non-naïve animals as accomplished by planned or natural infections.

In a further preferred example, the sow or gilt is vaccinated intramuscularly or orally at 5-weeks pre-farrowing and then 2-weeks pre-farrowing. Under these conditions, a protective immune response can be demonstrated in PEDV-negative vaccinated sows in that they developed antibodies (measured via fluorescent focal neutralization titer from serum samples) with neutralizing activity, and these antibodies were passively transferred to their piglets. The protocols of the invention are also applicable to the treatment of already seropositive sows and gilts, and also piglets and boars. Booster vaccinations can also be given and these may be via a different route of administration. Although it is preferred to re-vaccinate a mother sow prior to any subsequent farrowings, the vaccine compositions of the invention nonetheless can still provide protection to piglets via ongoing passive transfer of antibodies, even if the mother sow was only vaccinated in association with a previous farrowing.

It should be noted that piglets may then be vaccinated as early as Day 1 of life. For example, piglets can be vaccinated at Day 1, with or without a booster dose at 3 weeks of age, particularly if the parent sow, although vaccinated pre-breeding, was not vaccinated pre-farrowing. Piglet vaccination may also be effective if the parent sow was previously not naïve either due to natural or planned infection. Vaccination of piglets when the mother has neither been previously exposed to the virus, nor vaccinated pre-farrowing may also effective. Boars (typically kept for breeding purposes) should be vaccinated once every 6 months. Variation of the dose amounts is well within the practice of the art. It should be noted that the vaccines of the present invention are safe for use in pregnant animals (all trimesters) and neonatal swine. The vaccines of the invention are attenuated to a level of safety (i.e. no mortality, only transient mild clinical signs or signs normal to neonatal swine) that is acceptable for even the most sensitive animals again including neonatal pigs. Of course, from a standpoint of protecting swine herds both from PEDV epidemics and persistent low level PEDV occurrence, programs of sustained sow vaccination are of great importance. It will be appreciated that sows or gilts immunized with PEDV MLV will passively transfer immunity to piglets, including PEDV-specific IgA, which will protect piglets from PEDV associated disease and mortality. Additionally, generally, pigs that are immunized with PEDV MLV will have a decrease in amount and/or duration or be protected from shedding PEDV in their feces, and further, pigs that are immunized with PEDV MLV will be protected from weight loss and failure to gain weight due to PEDV, and further, PEDV MLV will aid in stopping or controlling the PEDV transmission cycle.

It should also be noted that animals vaccinated with the vaccines of the invention are also immediately safe for human consumption, without any significant slaughter withhold, such as 21 days or less.

When provided therapeutically, the vaccine is provided in an effective amount upon the detection of a sign of actual infection. Suitable dose amounts for treatment of an existing infection include between about 10 and about $10^6$ $\log_{10}$ $TCID_{50}$, or higher, of virus per dose (minimum immunizing dose to vaccine release). A composition is said to be "pharmacologically acceptable" if its administration can be tolerated by a recipient. Such a composition is said to be administered in a "therapeutically or prophylactically effective amount" if the amount administered is physiologically significant.

At least one vaccine or immunogenic composition of the present invention can be administered by any means that achieve the intended purpose, using a pharmaceutical composition as described herein. For example, route of administration of such a composition can be by parenteral, oral, oronasal, intranasal, intratracheal, topical, subcutaneous, intramuscular, transcutaneous, intradermal, intraperitoneal, intraocular, and intravenous administration. In one embodiment of the present invention, the composition is administered by intramuscularly. Parenteral administration can be by bolus injection or by gradual perfusion over time. Any suitable device may be used to administer the compositions, including syringes, droppers, needleless injection devices, patches, and the like. The route and device selected for use will depend on the composition of the adjuvant, the antigen, and the subject, and such are well known to the skilled artisan. Administration that is oral, or alternatively, subcutaneous, is preferred. Oral administration may be direct, via water, or via feed (solid or liquid feed). When provided in liquid form, the vaccine may be lyophilized with reconstitution, pr provided as a paste, for direct addition to feed (mix in or top dress) or otherwise added to water or liquid feed.

Generation of Vero Cells Suitable for Large Scale Virus Production

Viruses of the invention can be conveniently grown in Vero cell stocks that are approved for vaccine production. To generate safe and approved cell stock, a vial of Vero cells was subject to additional passaging. The cells were passed four times in PMEM w/wheat to produce Master Cell Stock (MCS) Lot "1834430". The MCS was tested in accordance with 9CFR & EP requirements in PGM-Biological Quality Control; Lincoln, Nebr. The MCS tested satisfactory for sterility, freedom from mycoplasmas, and extraneous agents. Therefore, PF-Vero MCS lot "1834430", is deemed eligible for submission to the Center for Veterinary Biologics Laboratories (CVB-L) for confirmatory testing.

Seed Origin and Passage History is as follows. A Pre-master Cell stock of global Vero cells was previously frozen. For production of the cell stock, the cells were grown in PMEM (Lincoln item #00-0779-00) containing 1% bovine serum (item #00-0710-00, BSE compliant) and 3 mM L-glutamine. They were derived from Vero WCS Pass #136, Lot #071700 MCS+3, 28 Jul. 2000. The new Pre-master cell stock was frozen at pass #166, which is MCS+33 from the original global Vero master cell stock. MCS "1833440" was produced from a pre-Master identified as Vero KZO pre-Master, Lot All cultures were grown in PMEM w/wheat, 1.0% L-glutamine and 1.0% Bovine Calf serum. Cells were planted (passage #167) in 150 cm2 T-Flasks on Aug. 14, 2008. The flasks were incubated in 5.0% CO2 at 36 1 C for 7 days then expanded. (passage #168) After flasks reached 100% confluency 4 days later, the cultures were passed (#169) into 850 cm2 roller bottles. Rollers were incubated at 36 1 C at 0.125-0.250 rpm without CO2. The final passage of rollers (#170) was done 4 days later. Cryopreservation was completed by adding 10.0% bovine calf serum and 10.0% dimethyl sulfoxide (DMSO) to the condensed cell suspension on 2 Sep. 2008. Vials were labeled as passage level #170. A total of 231 containers containing 4.2 ml were placed into a controlled rate freezer then transferred into liquid nitrogen tank for long term storage at vapor phase. The MCS was produced without the use of antibiotics. All reagents used in MCS production were sourced from Pfizer Global Manufacturing used for licensed antigen production in domestic and global markets. The MCS was produced by Pfizer's Master Seed Facility, Lincoln, Nebr.

Sterility Testing was as follows. The Master Cell Stock was tested as per 9CFR (026-ST0) and EP 2.6.1 from 29 Sep. 2008 to 13 Oct. 2008. The MCS was found to be free of bacteria and fungal contamination.

*Mycoplasma* Testing and Extraneous Testing were accomplished as follows. The MCS was tested as per 9CFR (028-PU0) and EP 2.6.7. The MCS was found to be free of any *Mycoplasma* contamination. Extraneous testing was completed as per 9CFR 113.52 using NL-BT-2 (Bovine), Vero, NL-ED-5 (Equine), NL-ST-1 (Porcine), NL-DK (Canine), NL-FK (Feline) cells. The MCS was negative for MGG, CPE and HAd and tested negative by FA for BVD, BRSV, BPV, BAV-1, BAV-5, Rabies, Reo, BTV, ERV, Equine arteritis, PPV, TGE, PAV, HEV, CD, CPV, FPL and FTP. The MCS was tested by ELISA for FIV and was found to be satisfactory.

EP extraneous testing was as per 5.2.4 (52-2002). Extraneous testing using Bovine NL-BT-2 and EBK (Primary), Vero, NL-ED-5 (Equine), NL-ST-1 (Porcine), MARC MA 104, NL-DK (Canine) NL-FK (Feline) cells were negative for MGG, CPE, HAd and tested negative by FA for BVD, BPV, BAV-1, BAV-5, Bovine corona, Bovine rotavirus, BHV-3, PI3, IBR, BRSV and BEV-1, Reo, BTV, ERV, Equine arteritis, PPV, PRV, TGE, HEV, PAV, P. rota A1, rota A2, PRRSV, CD, CPI, CAV-2, Measles, C. rota, Rabies, CCV, FP, FCV, FVR, FIP and FeLV.

Polypeptides and Polynucleotides of the Invention

Representative embodiments of the invention include an isolated polynucleotide sequence that comprises a polynucleotide selected from the group consisting of: (a) (SEQ ID NOs: 1, 2, 3, 8, 15, 35, 36, 37, 39, and/or 59-77); or a fragment thereof than encodes, ORF1a/1b polyproteins, the PEDV spike protein preferably domain 1, ORF3 protein, envelope protein, membrane protein, nucleocapsid protein or a fragment(s) of said proteins; (b) the complement of any sequence in (a); (c) a polynucleotide that hybridizes with a sequence of (a) or (b) under stringent conditions defined as hybridizing to filter bound DNA in 0.5M $NaHPO_4$, 7% SDS, 1 mM EDTA at 65° C., and washing in 0.1×SSC/0.1% SDS at 68° C.; (d) a polynucleotide that is at least 70% identical to the polynucleotide of (a) or (b); (e) a polynucleotide that is at least 80% identical to the polynucleotide of (a) or (b); (f) a polynucleotide that is at least 90% identical to the polynucleotide of (a) or (b); and (g) a polynucleotide that is at least 95% identical to the polynucleotide of (a) or (b). In a preferred embodiment the polynucleotide includes a second heterologous polynucleotide sequence.

The invention also provides a polypeptide encoded by any of the open reading frames of the genotype of SEQ ID NOs: 1, 2, 3, 8, 15, 35, 36, 37, 39, 59-78, combinations thereof, or a polypeptide that is at least 90% identical thereto, domains thereof, or to a fragment thereof, including the option that additional otherwise identical amino acids are replaced by conservative substitutions.

The invention also provides a polypeptide encoded by any of the open reading frames of the variant PEDV strain of the invention, preferably the spike protein, or more preferably spike protein S1 domain, or a polypeptide that is at least 90% identical thereto, or to a fragment thereof, including the option that additional otherwise identical amino acids are replaced by conservative substitutions.

In a preferred embodiment, the polypeptide is expressed from the first 1170 nucleotides of the S1 region of spike protein of the variant PEDV strain of the invention.

In a further preferred embodiment, there are further provided PEDV polypeptide-based vaccines wherein the antigen is defined by: a protein encoded by an open reading frames of SEQ ID NOs: 1, 2, 3, 8, 15, 35, 36, 37, 39, 59-77, combinations thereof, or an immunogenic fragment thereof. Further embodiments include an amino acid sequence where the antigen is: encoded by the nucleotides of the SEQ ID NOs: 23-34, 40-58.

Further Genetic Manipulations

The polynucleotide and amino acid sequence information provided by the present invention also makes possible the systematic analysis of the structure and function of the viral genes and their encoded gene products. Knowledge of a polynucleotide encoding a viral gene product of the invention also makes available anti-sense polynucleotides which recognize and hybridize to polynucleotides encoding a polypeptide of the invention, or a fragment thereof. Full length and fragment anti-sense polynucleotides are useful in this respect. The worker of ordinary skill will appreciate that fragment anti-sense molecules of the invention include (i) those which specifically recognize and hybridize to a specific RNA (as determined by sequence comparison of DNA encoding a viral polypeptide of the invention as well as (ii) those which recognize and hybridize to RNA encoding variants of the encoded proteins. Antisense polynucleotides that hybridize to RNA/DNA encoding other PEDV peptides are also identifiable through sequence comparison to identify characteristic, or signature sequences for the family of molecules, further of use in the study of antigenic domains in PEDV polypeptides, and may also be used to distinguish between infection of a host animal with remotely related non-PEDV members of the Circoviridae.

Guidance for effective codon optimization for enhanced expression in yeast and *E. coli* for the constructs of the invention is generally known to those of skill in the art.

Antibodies

Also contemplated by the present invention are anti-PEDV antibodies (e.g., monoclonal and polyclonal antibodies, single chain antibodies, chimeric antibodies, humanized, human, porcine, and CDR-grafted antibodies, including compounds which include CDR sequences which specifically recognize a PEDV polypeptide of the invention. The term "specific for" indicates that the variable regions of the antibodies of the invention recognize and bind a PEDV polypeptide exclusively (i.e., are able to distinguish a single PEDV polypeptide from related polypeptides despite sequence identity, homology, or similarity found in the family of polypeptides), and which are permitted (optionally) to interact with other proteins (for example, *S. aureus* protein A or other antibodies in ELISA techniques) through interactions with sequences outside the variable region of the antibodies, and in particular, in the constant region of the Ab molecule. Screening assays to determine binding specificity of an antibody of the invention are well known and routinely practiced in the art. For a comprehensive discussion of such assays, see Harlow et al. (Eds), Antibodies A Laboratory Manual; Cold Spring Harbor Laboratory; Cold Spring Harbor, N.Y. (1988), Chapter 6. Antibodies that recognize and bind fragments of the PEDV polypeptides of the invention are also contemplated, provided that the antibodies are first and foremost specific for, as defined above, a PEDV polypeptide of the invention from which the fragment was derived.

For the purposes of clarity, "antibody" refers to an immunoglobulin molecule that can bind to a specific antigen as the result of an immune response to that antigen. Immunoglobulins are serum proteins composed of "light" and "heavy" polypeptide chains having "constant" and "variable" regions and are divided into classes (e.g., IgA, IgD, IgE, IgG, and IgM) based on the composition of the constant regions. Antibodies can exist in a variety of forms including, for example, as, Fv, Fab', F(ab') 2, as well as in single chains, and include synthetic polypeptides that contain all or part of one or more antibody single chain polypeptide sequences.

Diagnostic Kits

The present invention also provides diagnostic kits. The kit can be valuable for differentiating between porcine animals naturally infected with a field strain of a PEDV virus and porcine animals vaccinated with any of the PEDV vaccines described herein. The kits can also be of value because animals potentially infected with field strains of PEDV virus can be detected prior to the existence of clinical symptoms and removed from the herd, or kept in isolation away from naive or vaccinated animals. The kits include reagents for analyzing a sample from a porcine animal for the presence of antibodies to a particular component of a specified PEDV virus. Diagnostic kits of the present invention can include as a component a peptide or peptides from the variant PEDV strain of the invention which is present in a field strain but not in a vaccine of interest, or vice versa, and selection of such suitable peptide domains is made possible by the extensive amino acid sequencing. As is known in the art, kits of the present invention can alternatively include as a component a peptide which is provided via a fusion protein. The term "fusion peptide" or "fusion protein" for purposes of the present invention means a single polypeptide chain consisting of at least a portion of a PEDV virus protein, preferably of ORF1, or ORF3 and a heterologous peptide or protein.

The following Examples are intended to illustrate the above invention and should not be construed as to narrow its scope. One skilled in the art will readily recognize that the Examples suggest many other ways in which the invention could be practiced. It should be understood that numerous variations and modifications may be made while remaining within the scope of the invention.

All the inventions disclosed herein are made under a Joint Research Agreement (as defined by 35 USC 100(h), 37 CFR 1.9(e)) that exists between the inventors' respective assignees, Iowa State University and Zoetis Services LLC, and the inventions are thus eligible for the examination protections accorded by 37 CFR 1.104 (C)(4)(5).

EXAMPLES

Example 1

PEDV S1 (first 2.2 kb portion of the spike gene) sequencing was undertaken to help determine the genetic relatedness and molecular epidemiology of PEDV in US swine. Sequencing was performed on 15 PEDV cases at ISU VDL in January 2014. Among them, PEDV S1 sequences from 10 cases (ISU cases 6-15) are similar to each other and to the PEDV strains identified in US swine in 2013 (99.1-100% nucleotide identities). In distinct contrast, the PEDV S1 sequences from the other 5 cases (ISU cases 1-5) only have 93.9-94.6% nucleotide identities to the PEDV strains previously identified in US swine in 2013.

However, these 5 PEDV cases shared 99.6-100% nucleotide identities to each other based on the S1 sequences. Phylogenetic analysis based on the 51 sequences demonstrated that the aforementioned 10 PEDV cases (ISU cases 6-15) clustered together with PEDV strains identified in US since April 2013. However, the aforementioned 5 PEDV cases (ISU cases 1-5) clustered very differently from the PEDV strains previously identified in US swine (FIG. 1). Sequence alignment showed that the S1 sequences of these 5 PEDV cases had some deletions and insertions compared to PEDV viruses previously identified in US.

The S1 gene of this new virus isolate has been determined and is reported herein as SEQ ID NO: 1. Based on the data currently available, it appears unlikely that this strain is a mutant evolved from PEDV previously identified in US swine. The PEDV real-time RT-PCR offered at ISU VDL is targeting the nucleocapsid (N) gene. The N-gene is known to be a conserved portion of the PEDV genome. Thus far, the PEDV N-gene real-time RT-PCR being conducted at the ISU VDL seems to be readily detecting these new PEDVs. The full-length N gene sequences of the new PEDVs have been determined and were similar to the PEDVs previously identified in the US.

Figure 2A:
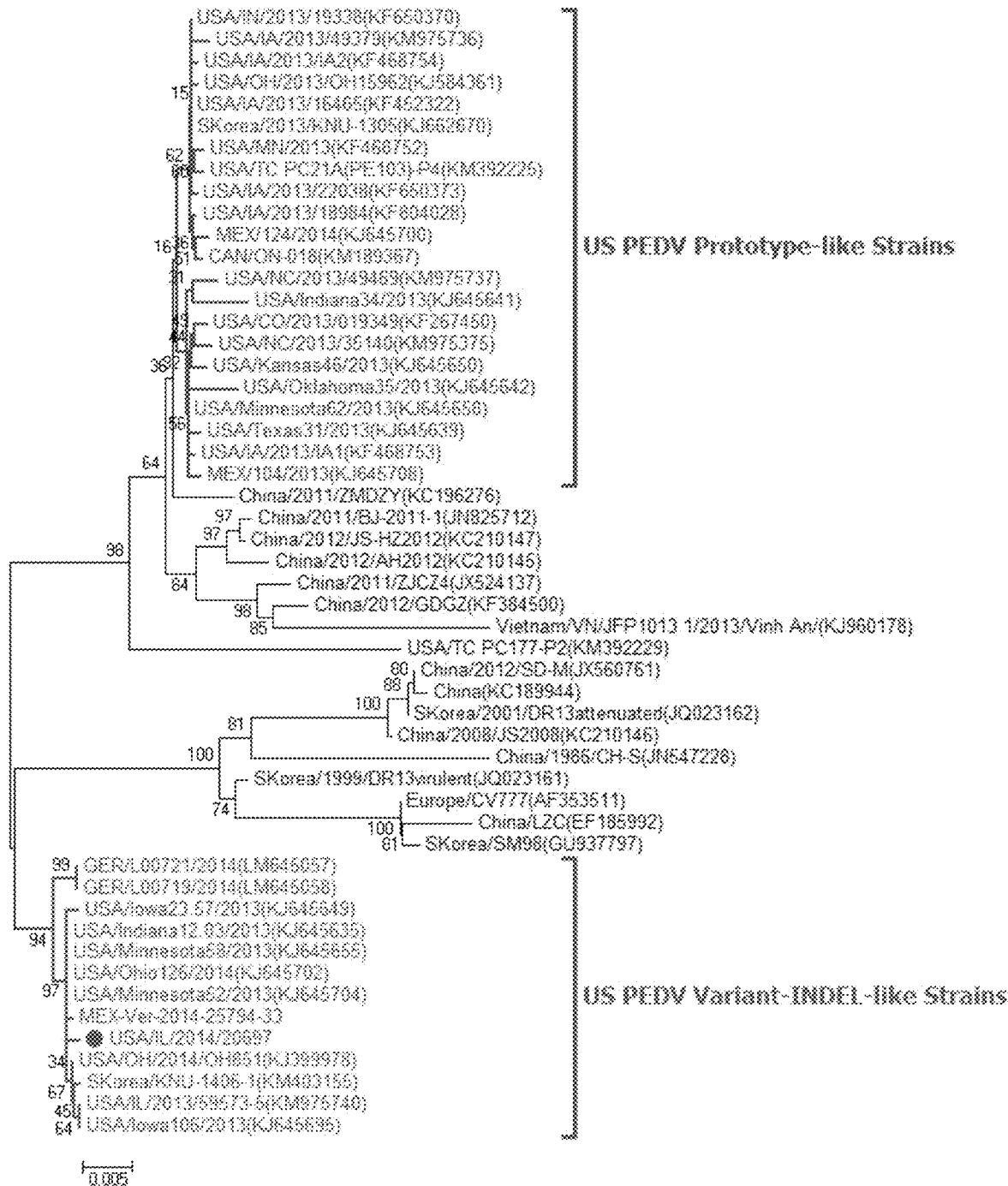
FIG. 2A illustrates Phylogenetic analysis of 52 global PEDVs based on the S1 portion sequences.
Figure 2B:
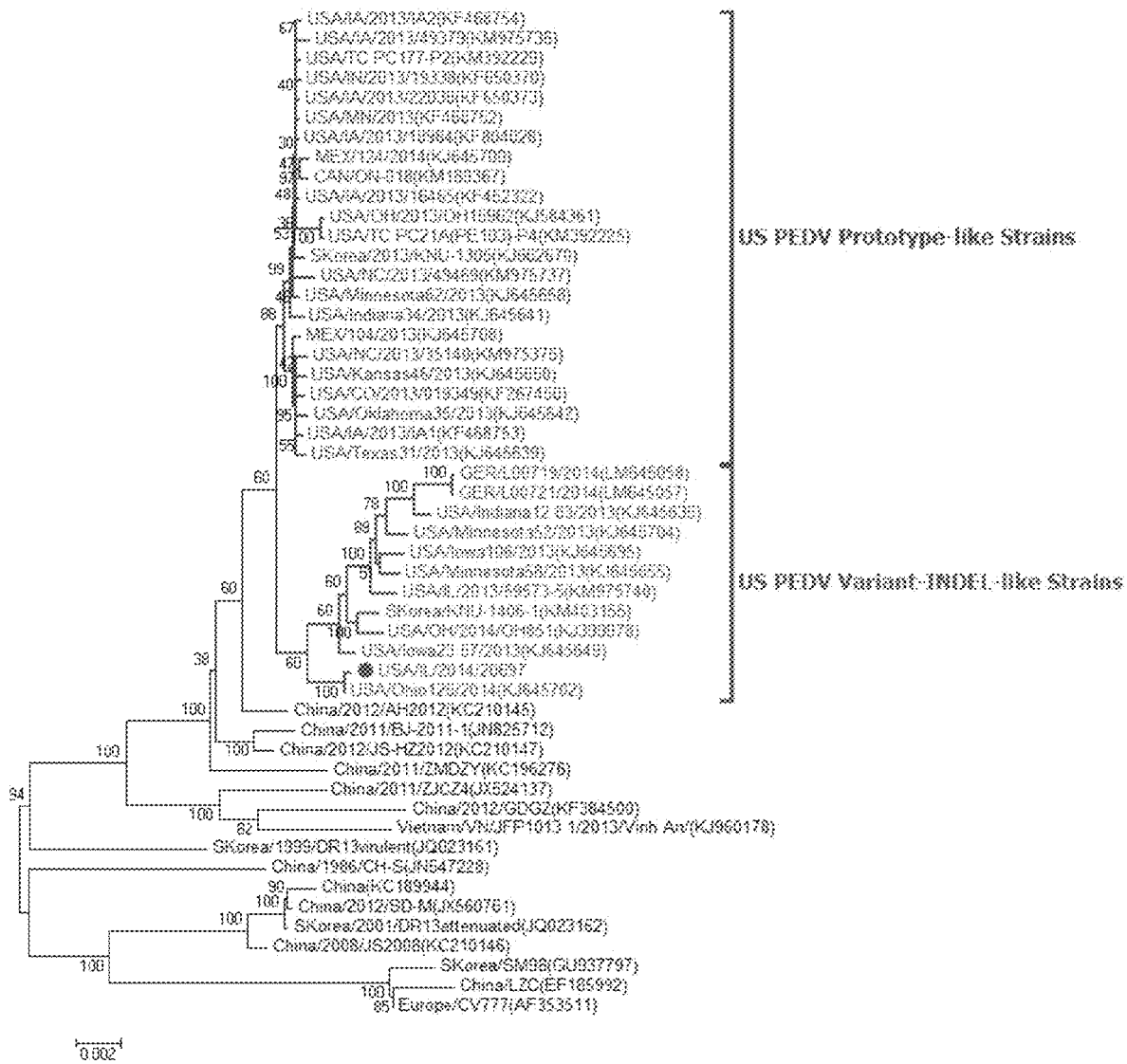
FIG. 2B illustrates Phylogenetic analysis of 51 global PEDVs based on the whole genome sequences. One can see that, in addition to in US swine, the US prototype-like strains have been detected in South Korea, Canada and Mexico; the US variant-INDEL-like strains have been detected in South Korea, Mexico and Germany.
Figure 4A:
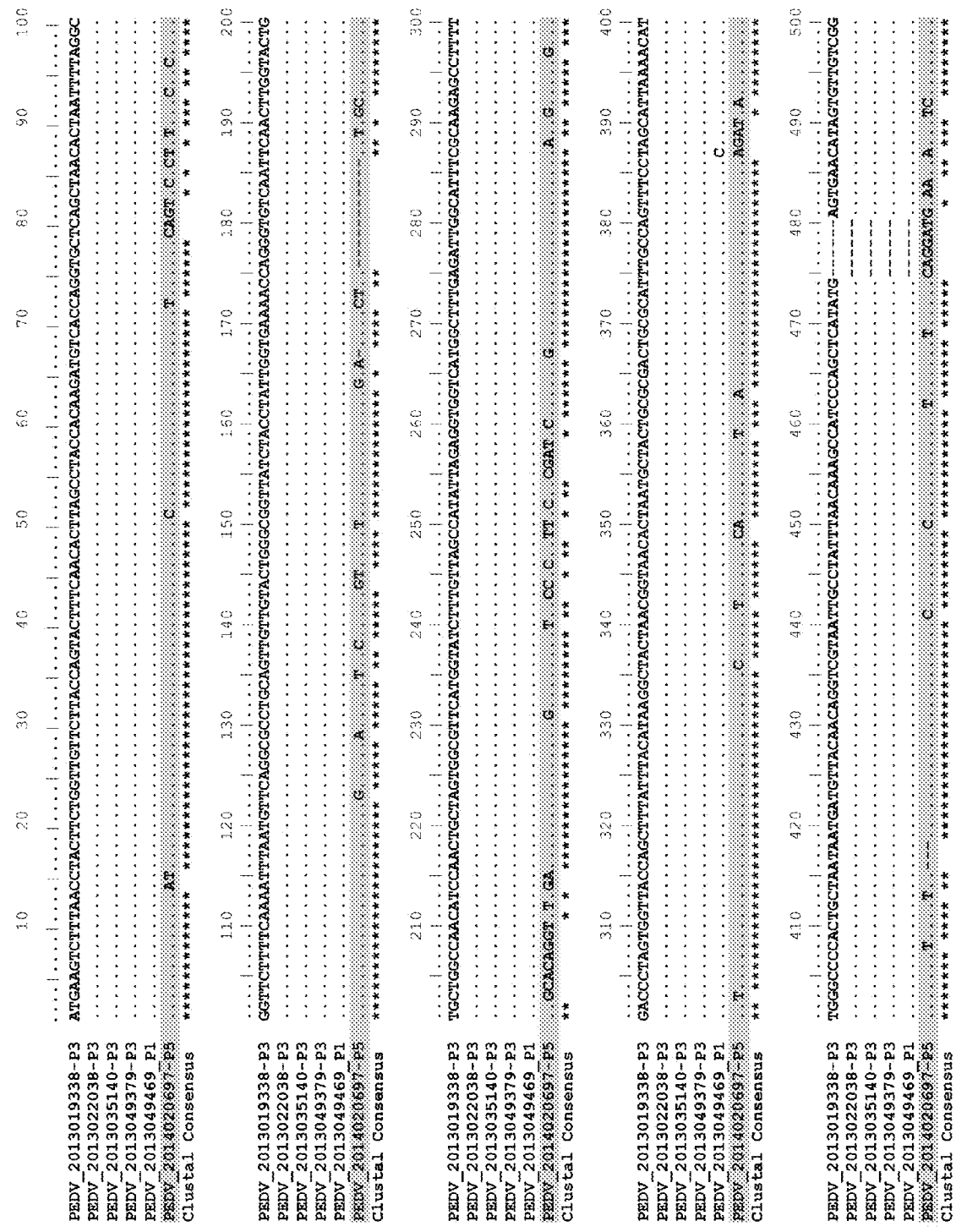
Figure 4C:
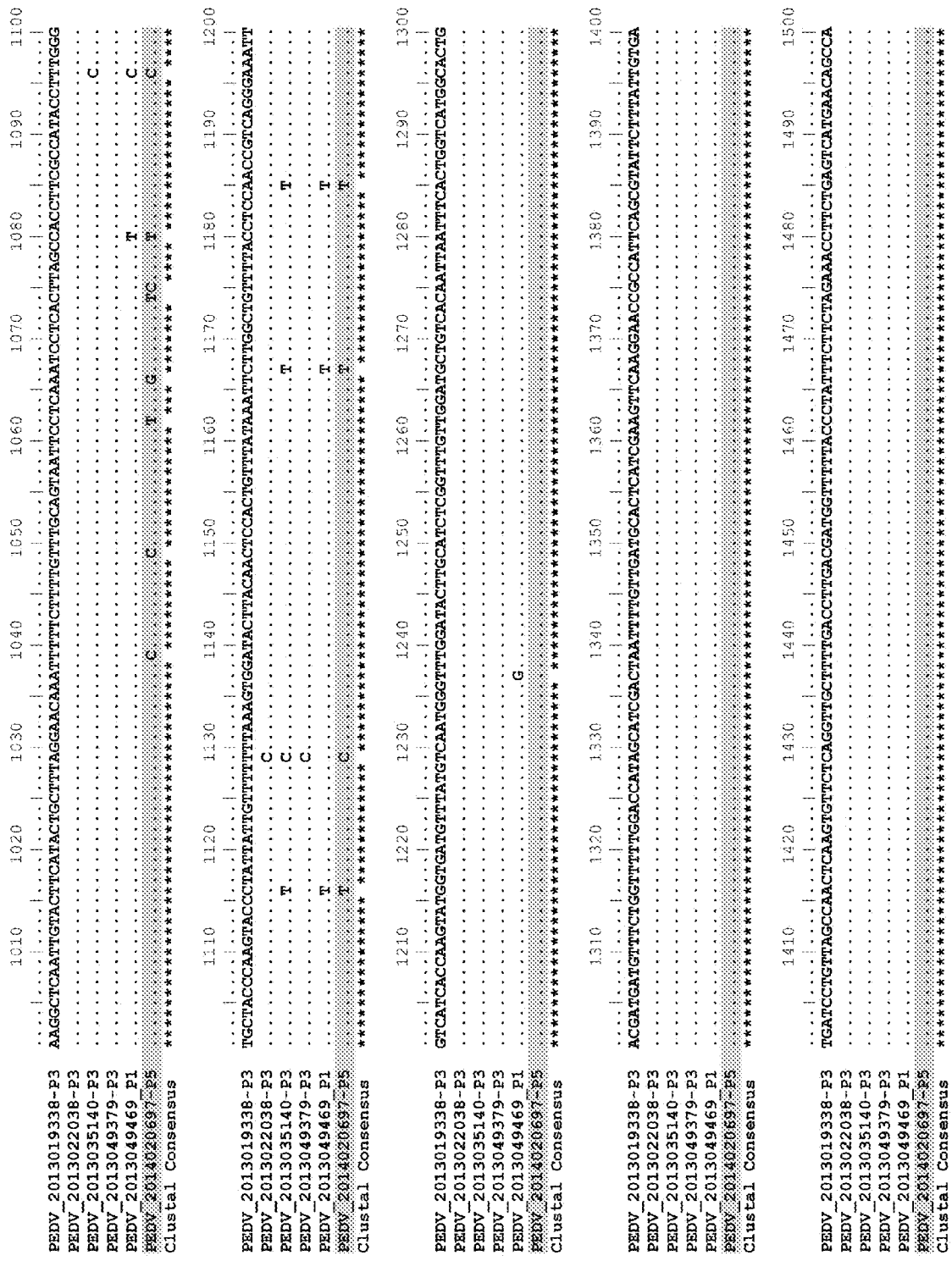
Figure 4D:
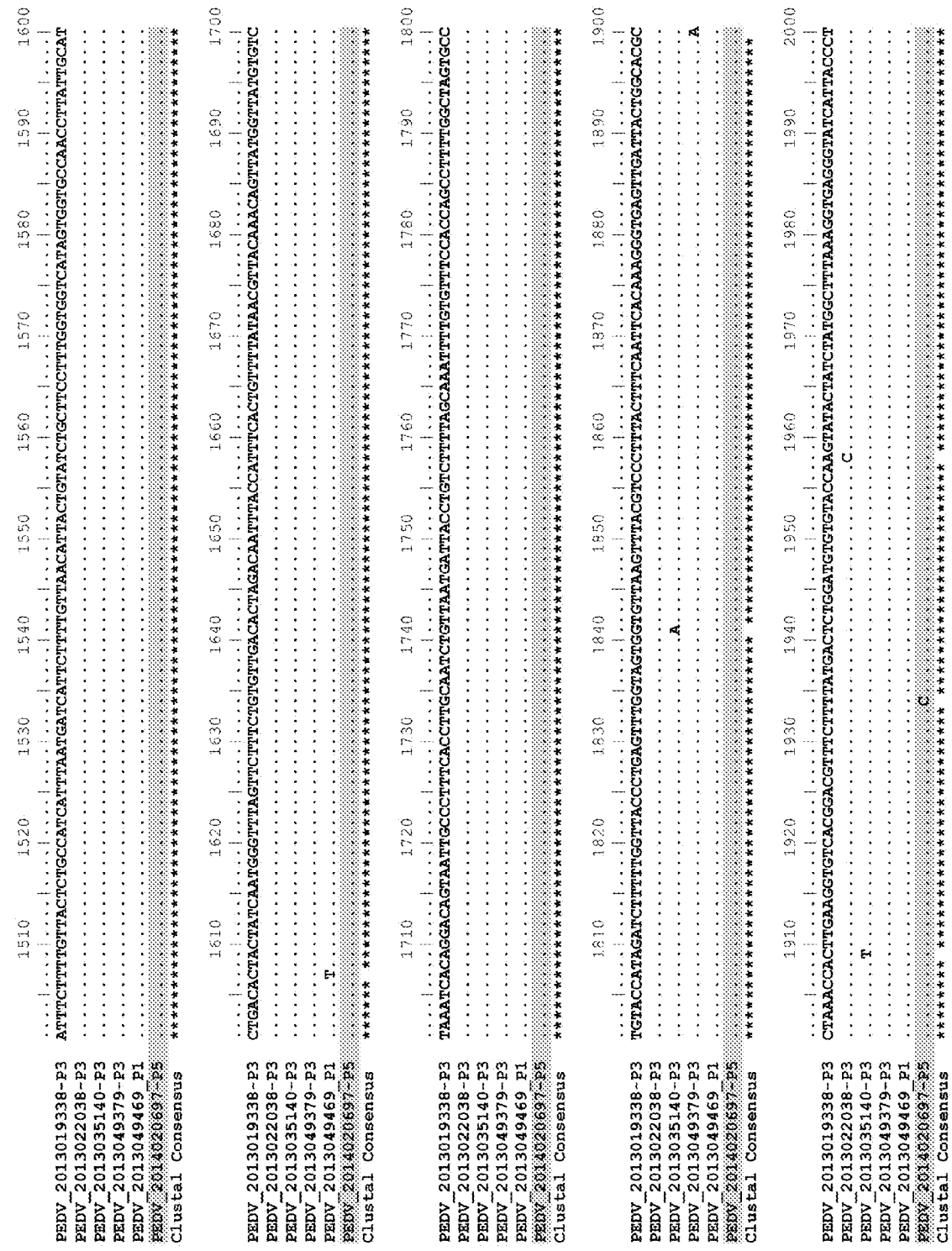
Figure 4F:
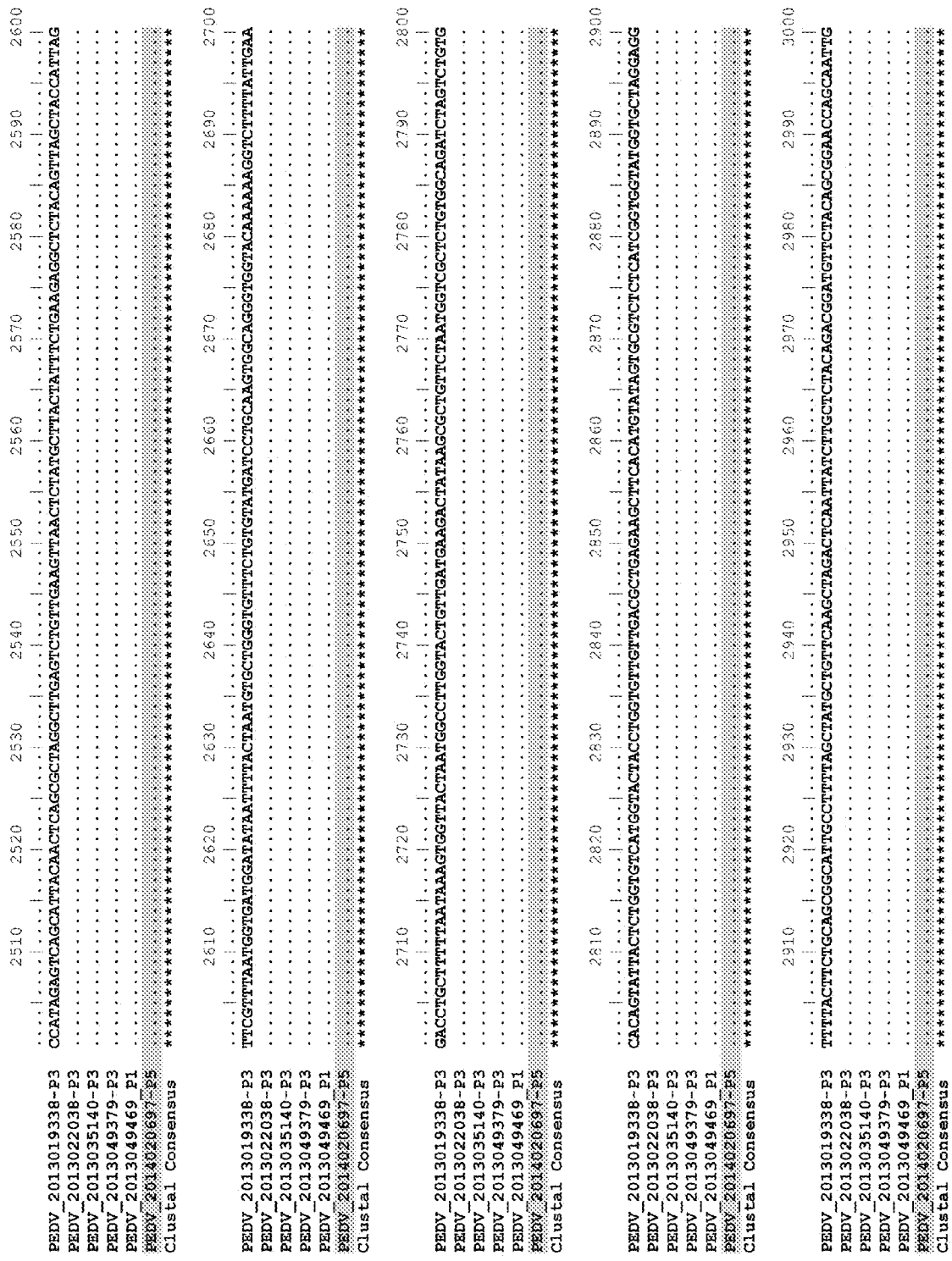
Figure 4G:
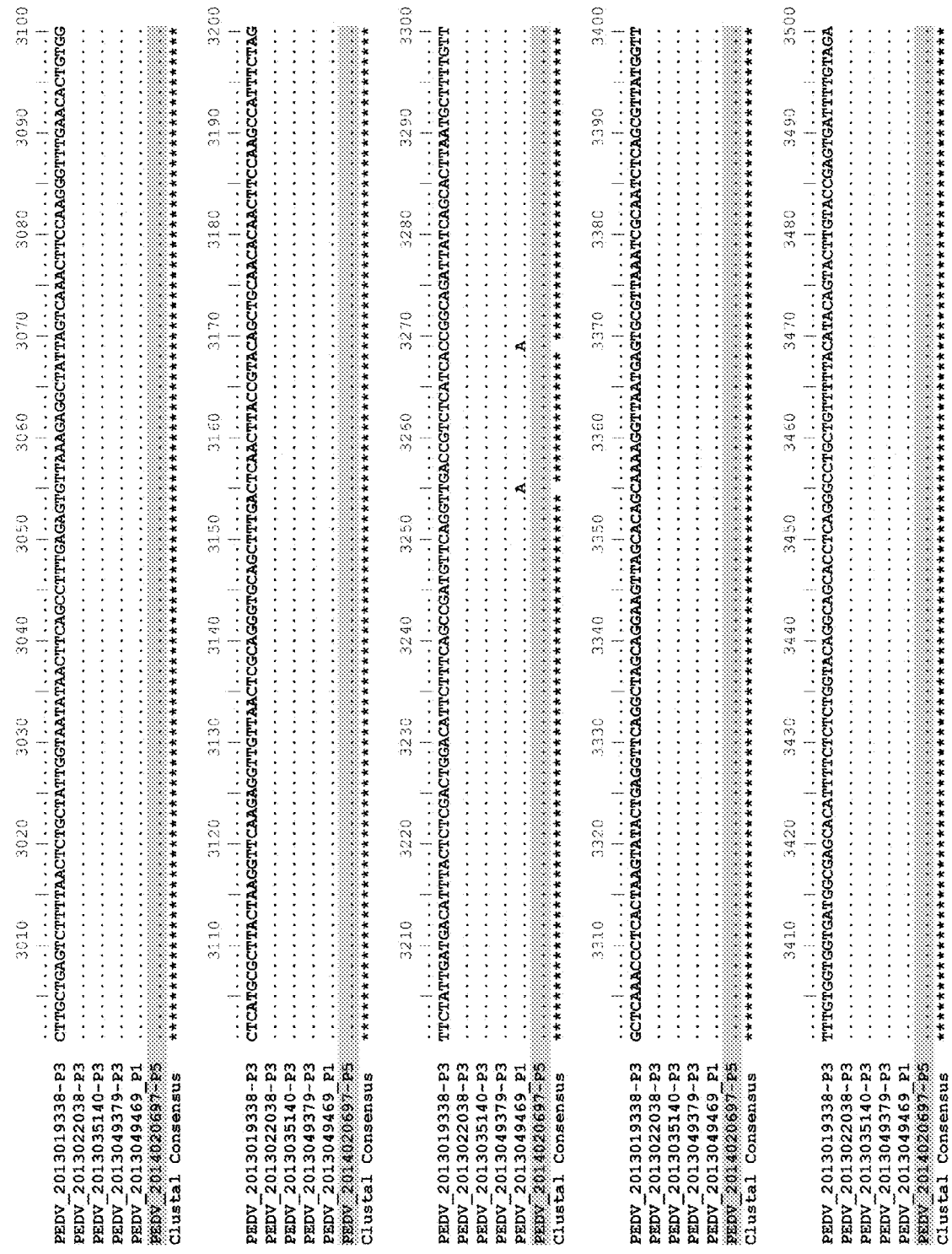
Figure 4H:
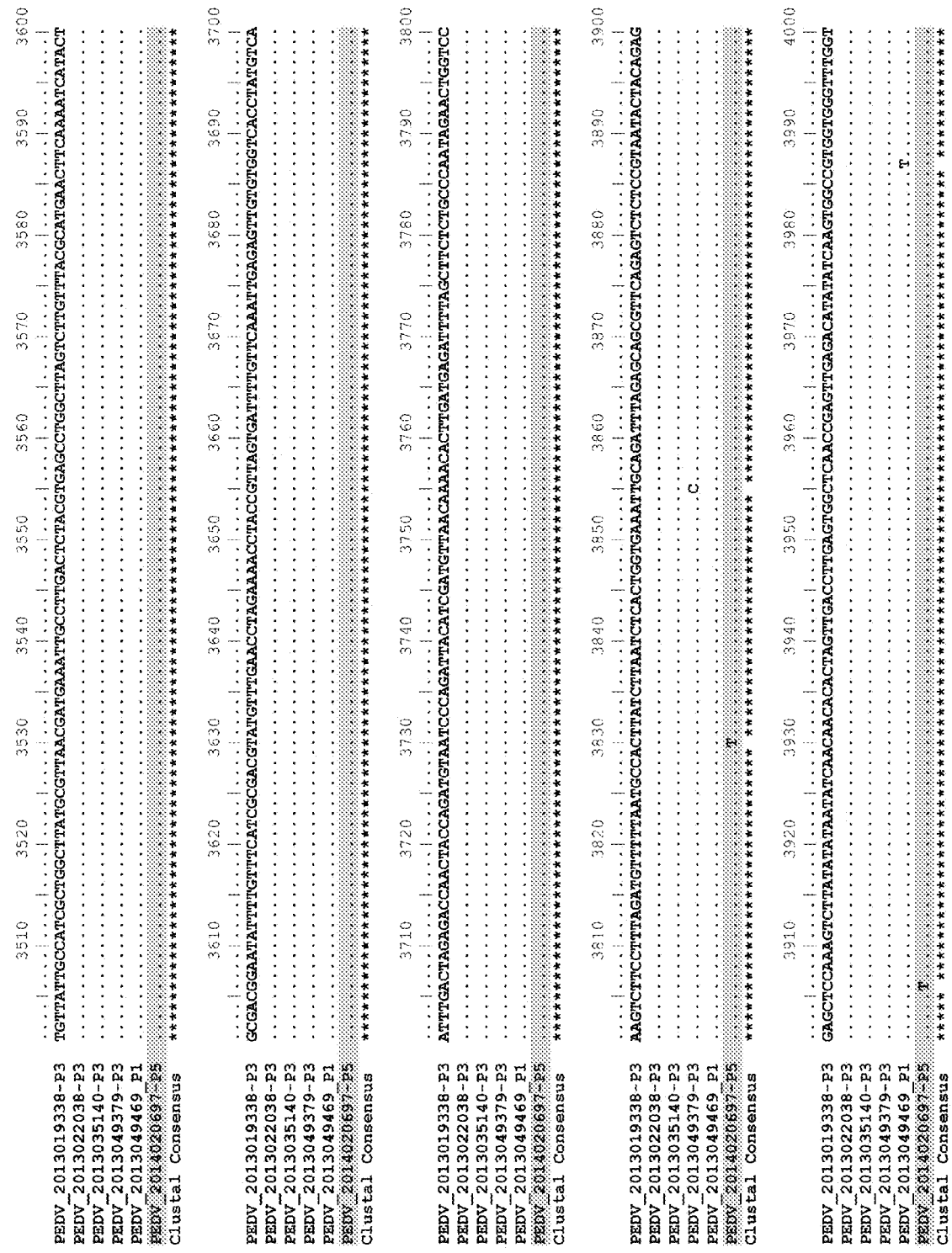
Figure 5A:
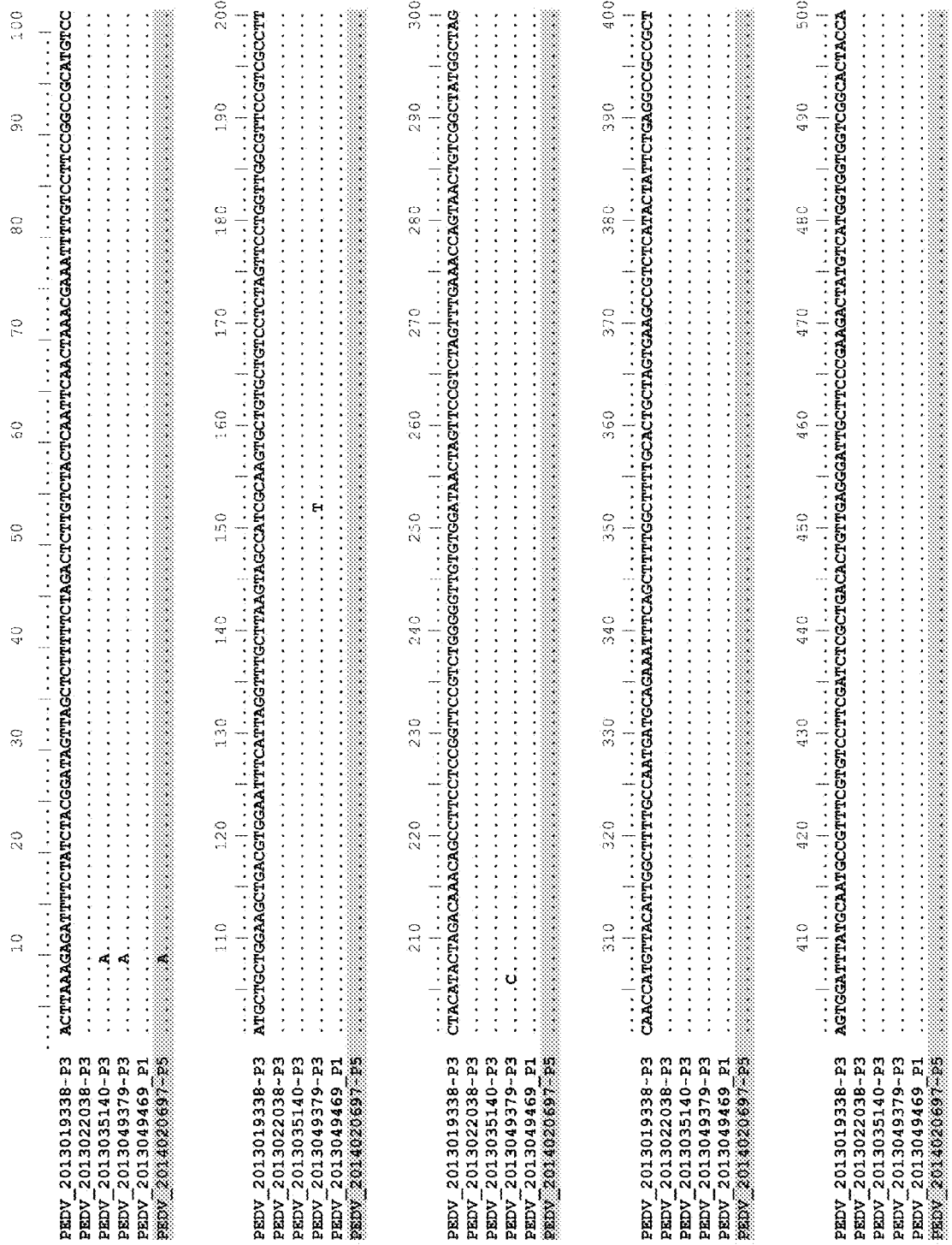
FIGS. 5A-5EEE are a comparison of the whole genome of PEDV US variant isolate 2014020697-P5 passage 5, lineage 1 (SEQ ID NO:8) to the PEDV US prototype isolates 2013019338-P3 passage 3 (SEQ ID NO:9), 2013022038-P3 passage 3 (SEQ ID NO:10), 2013035140-P3 passage 3 (SEQ ID NO:11), 2013049379-P3 passage 3 (SEQ ID NO:12), and 2013049469-P1 passage 1 (SEQ ID NO:13), identical bases are indicated with dots.
Figure 5B:
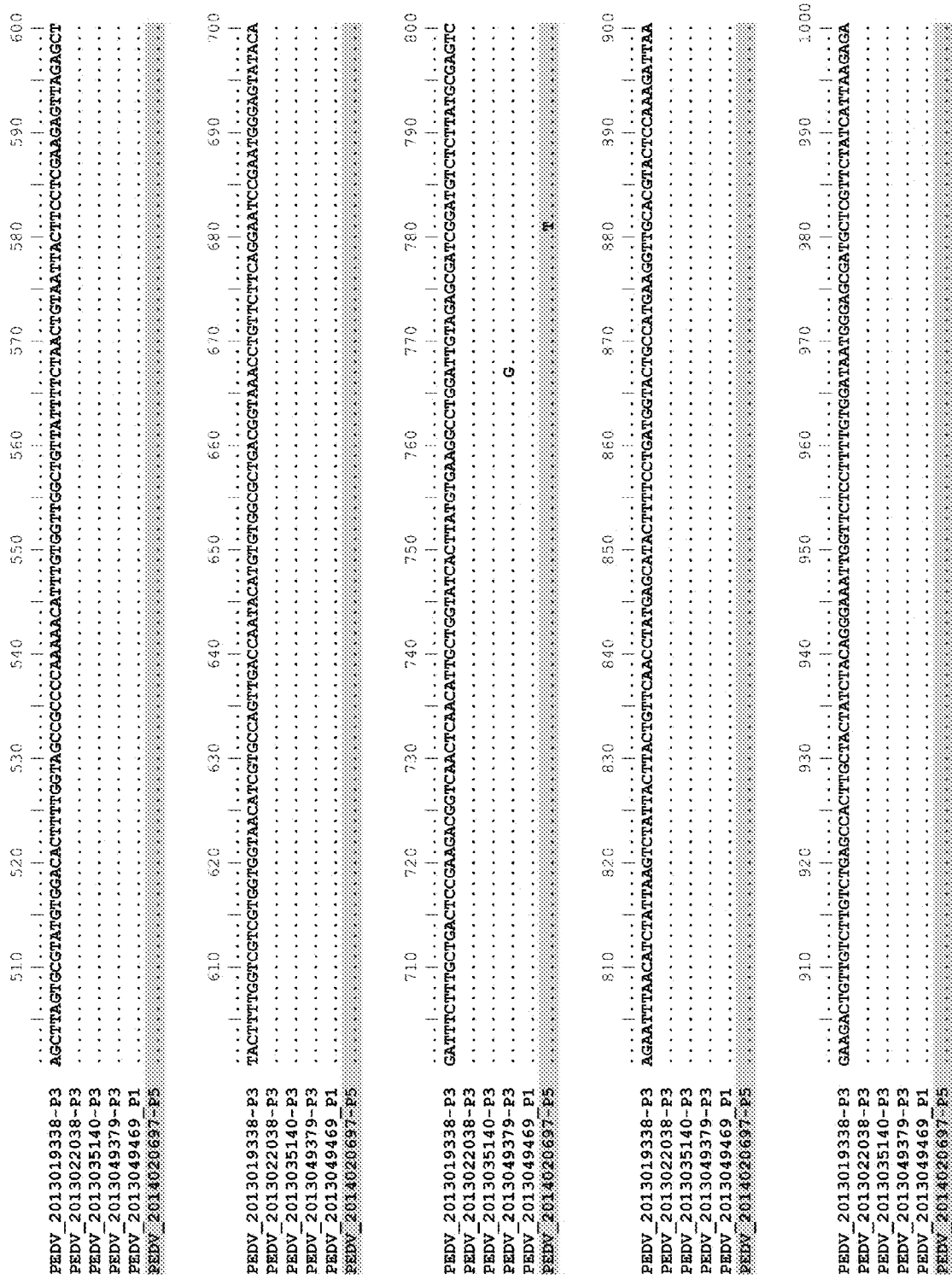
Figure 5C:
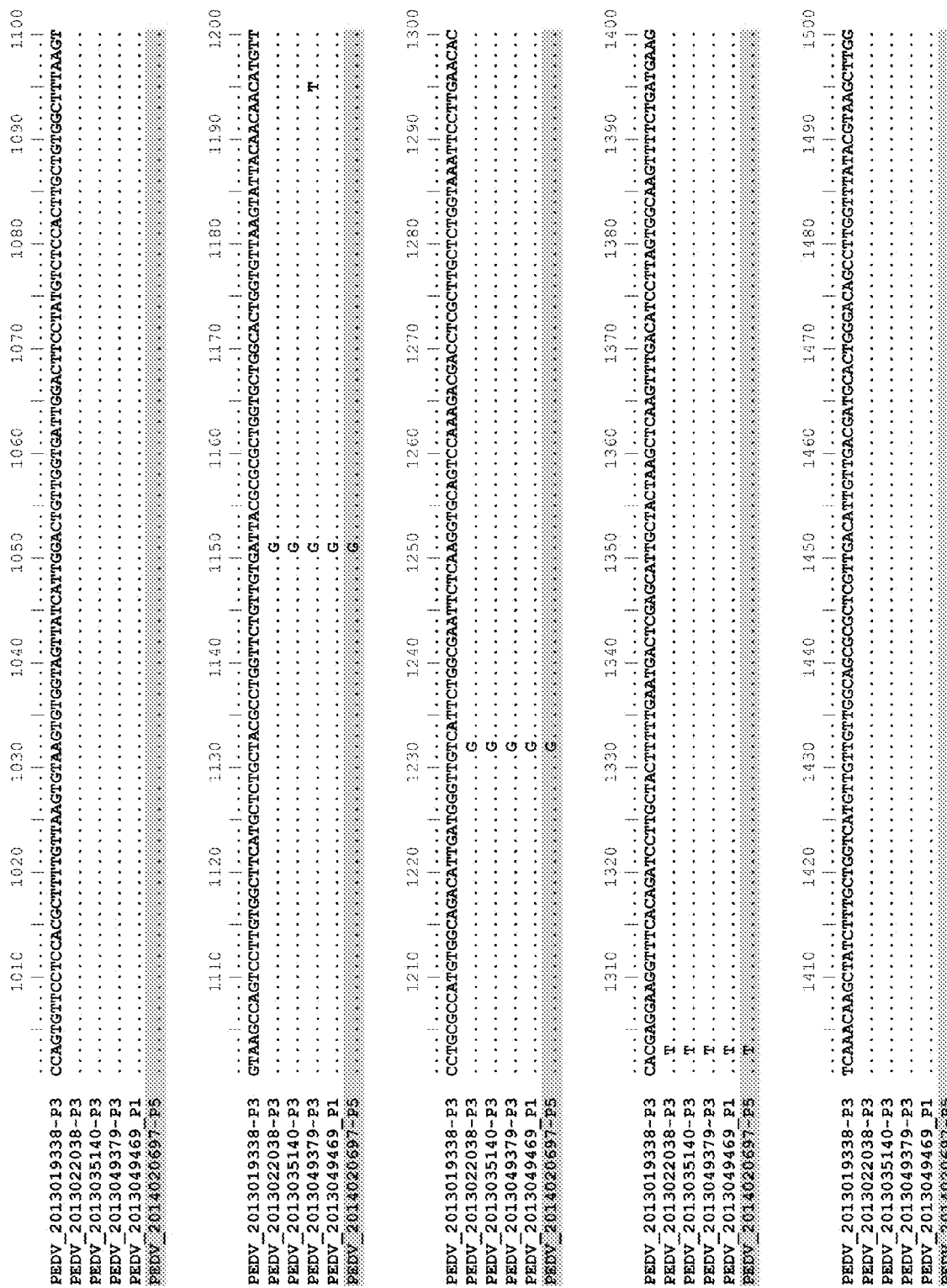
Figure 5E:
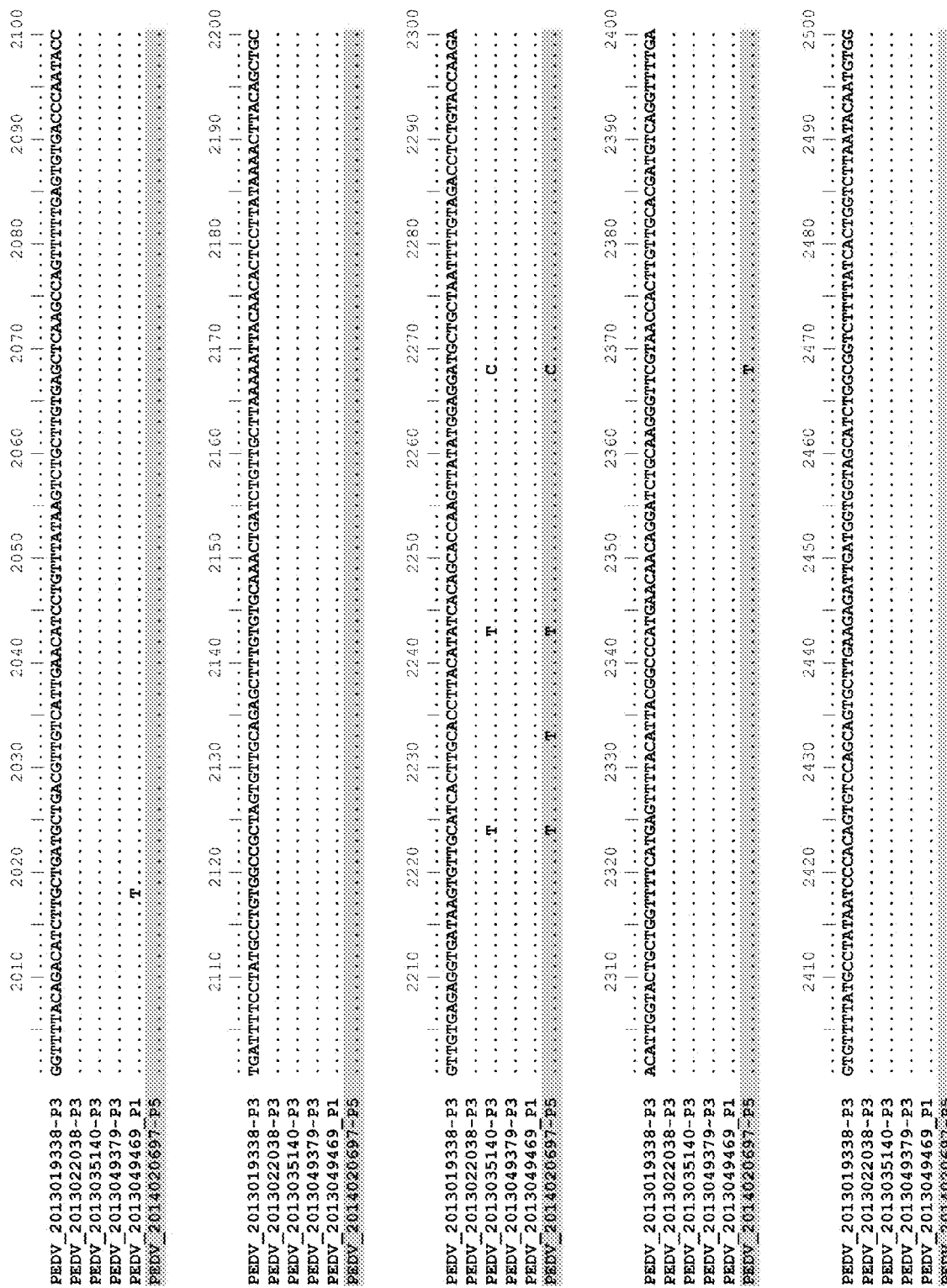
Figure 5F:
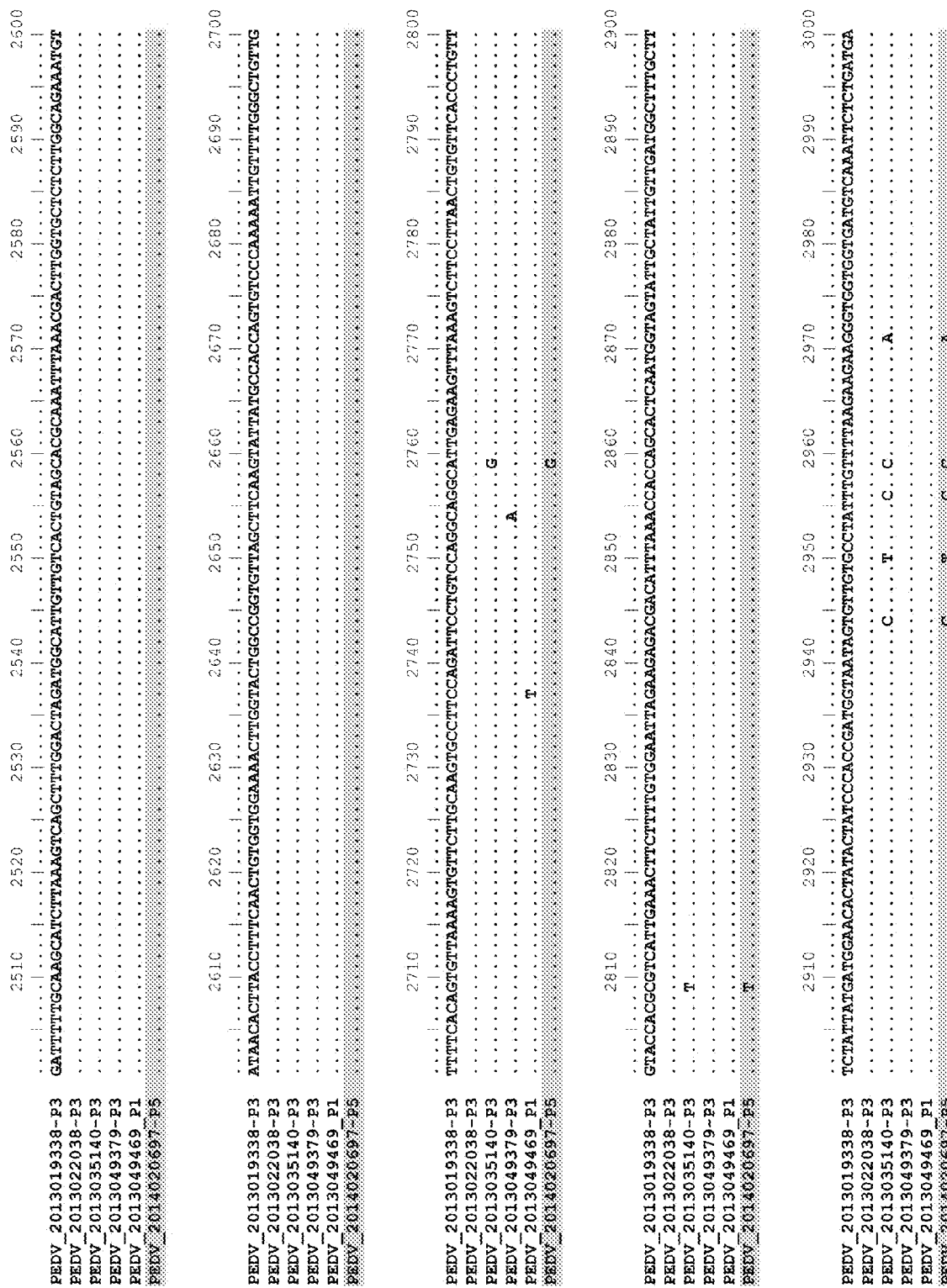
Figure 5G:
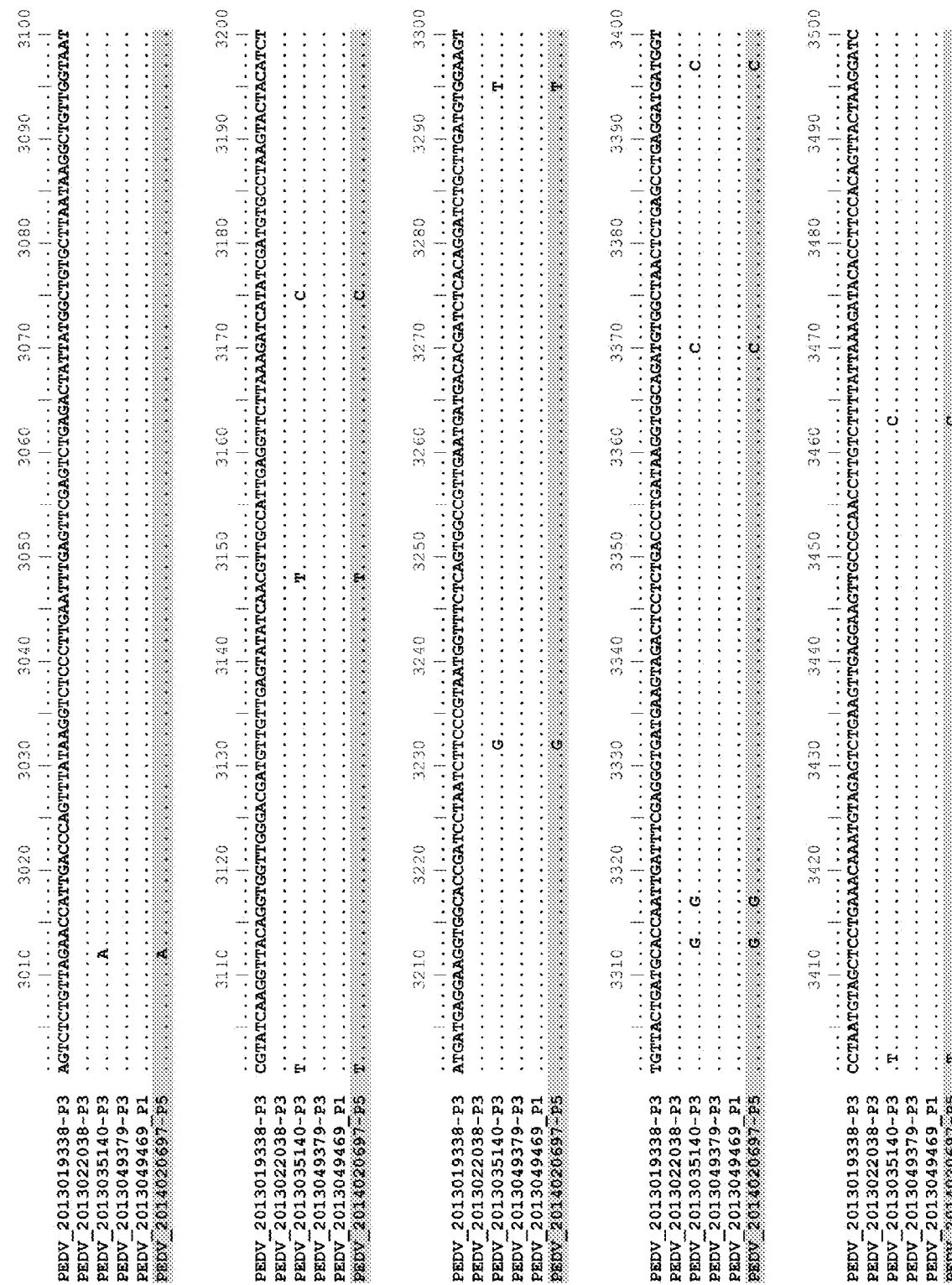
Figure 5H:
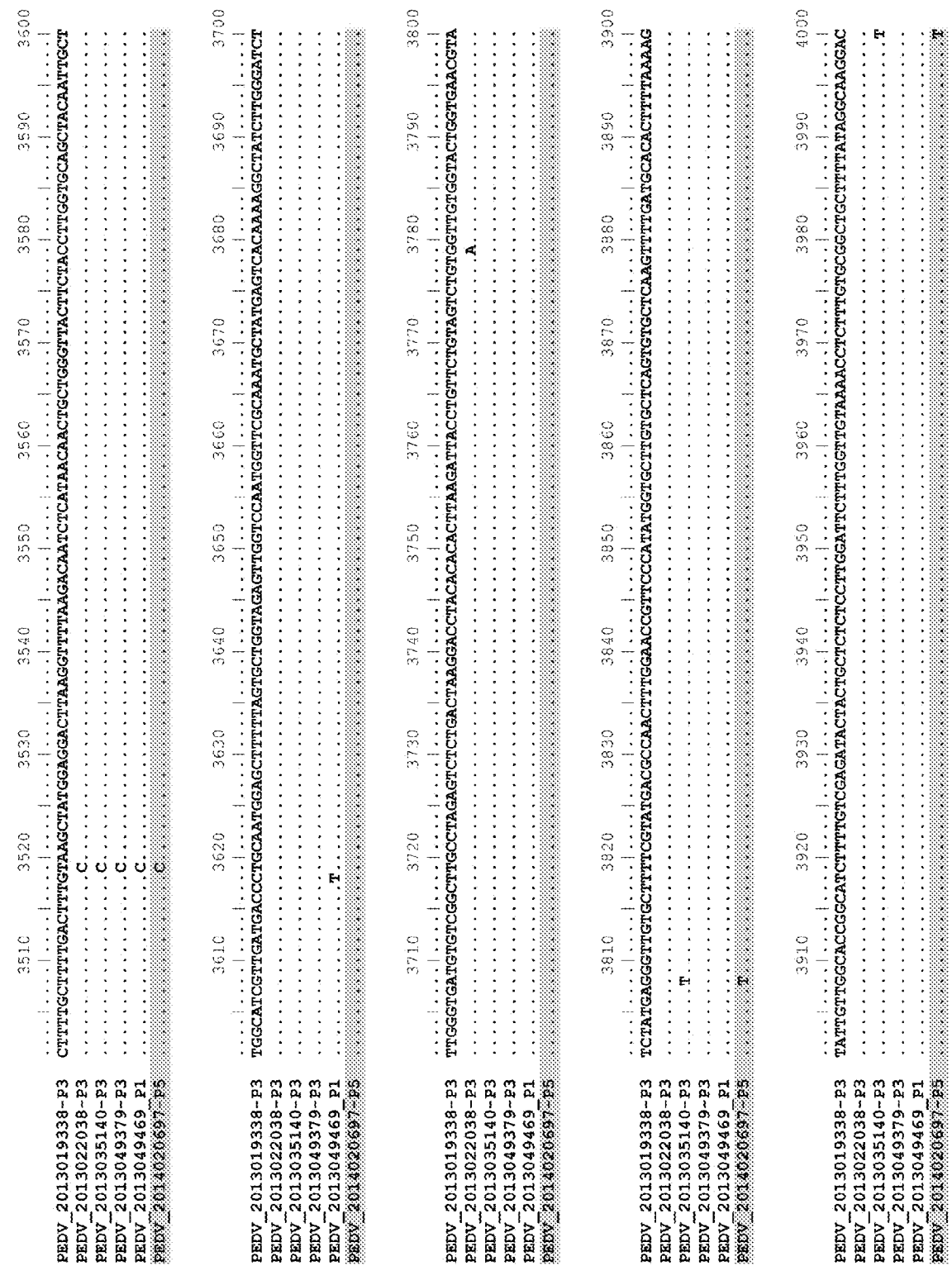
Figure 51:
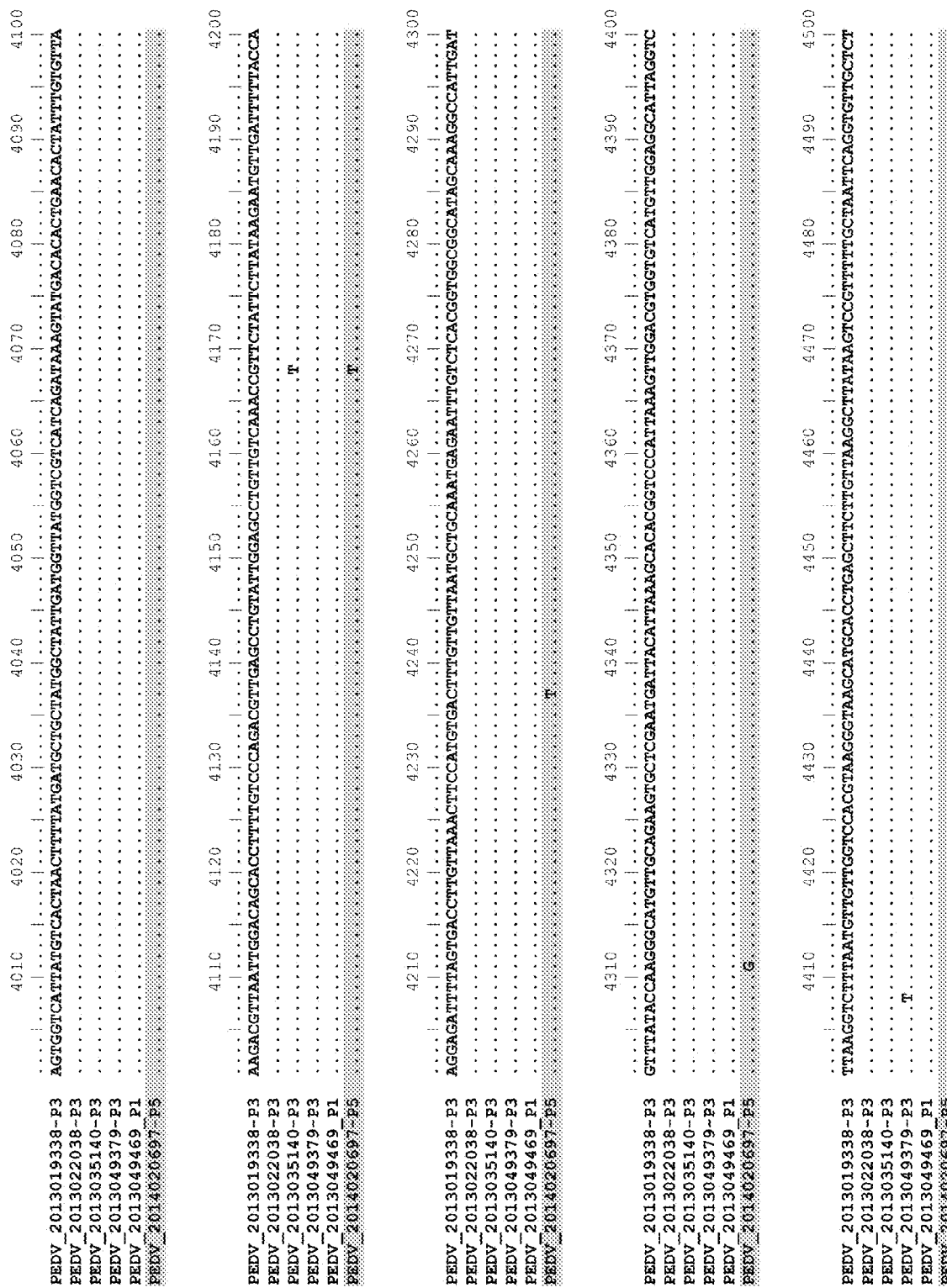
Figure 5J:
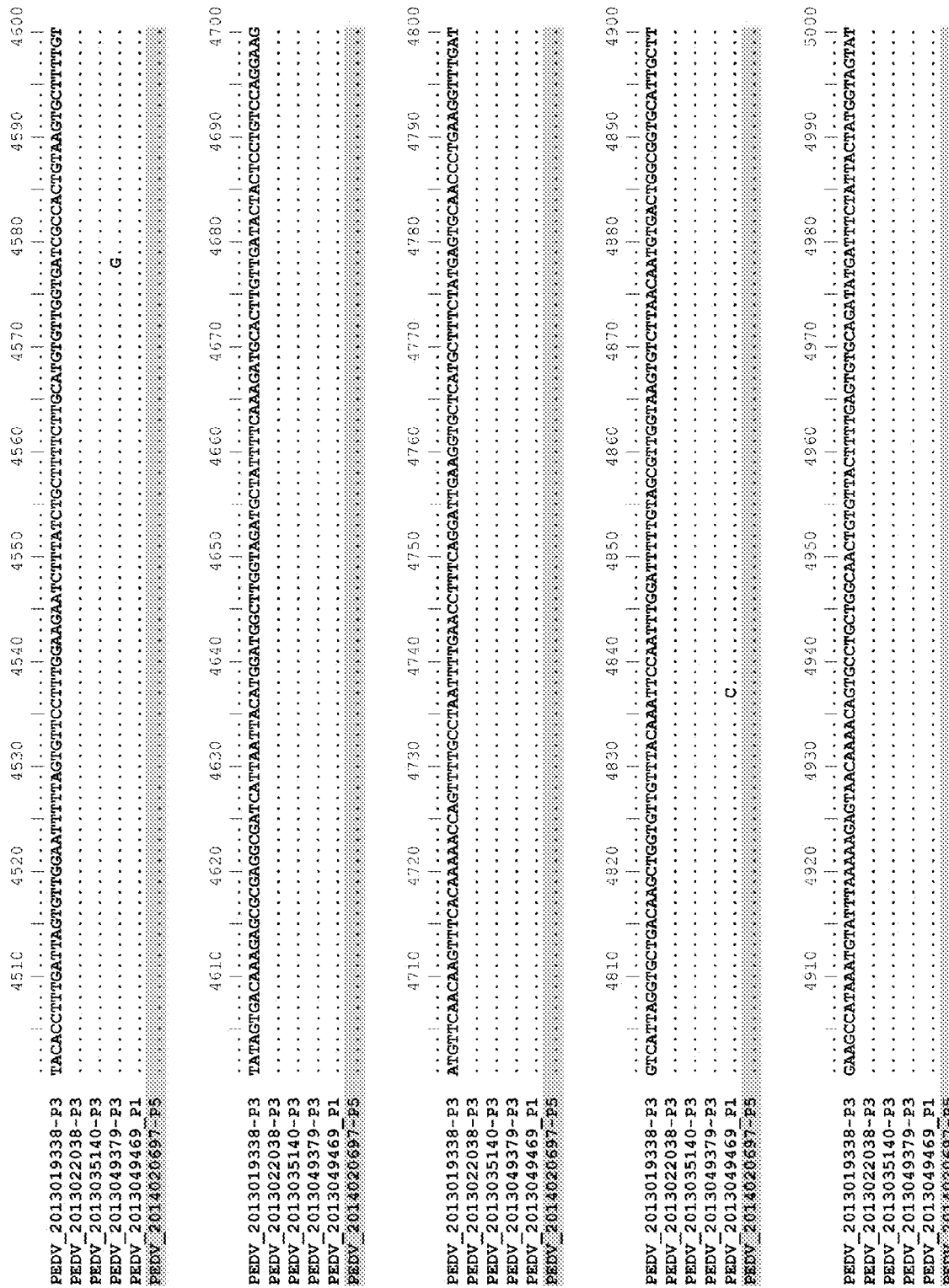
Figure 5M:
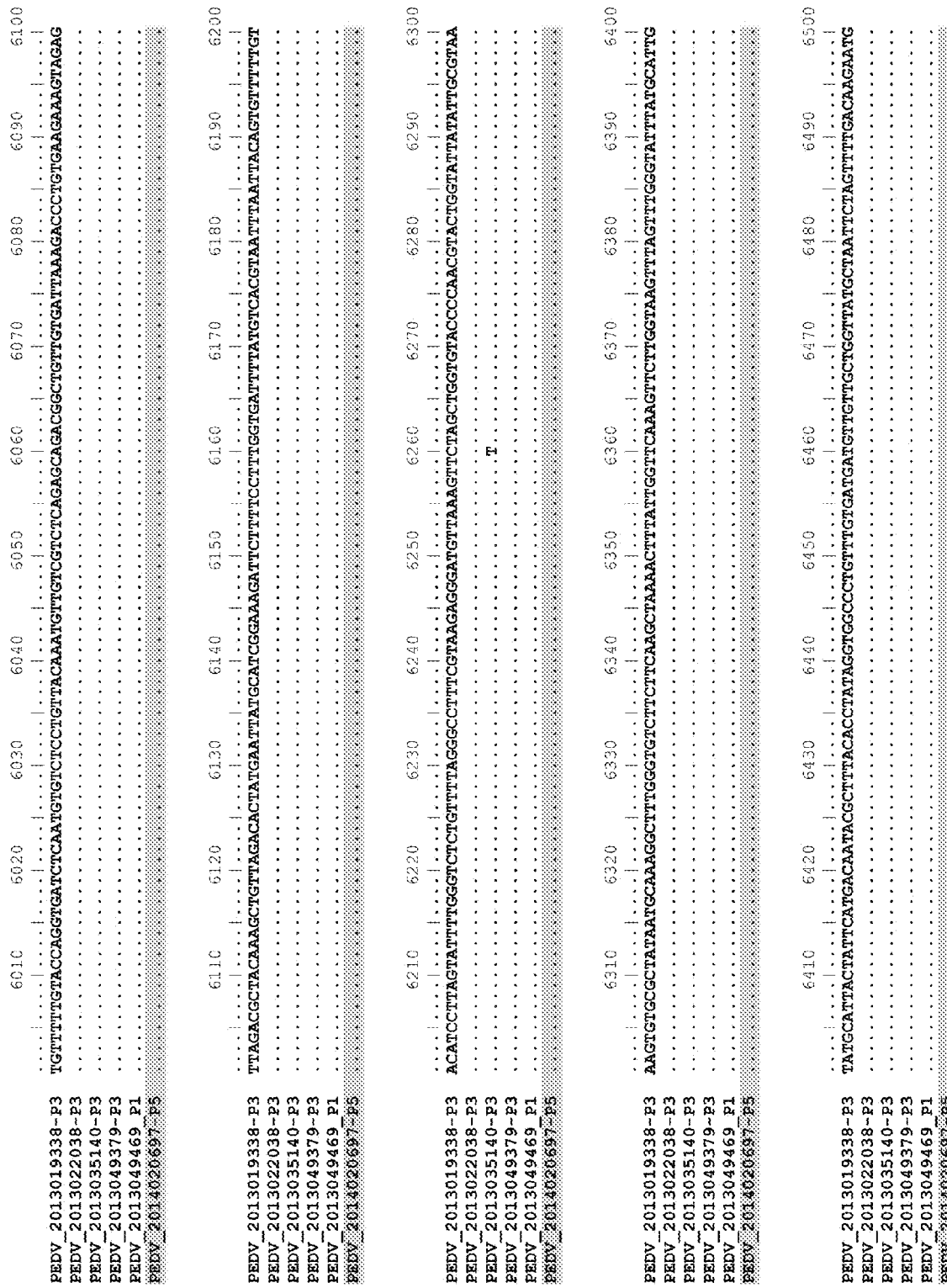
Figure 5N:
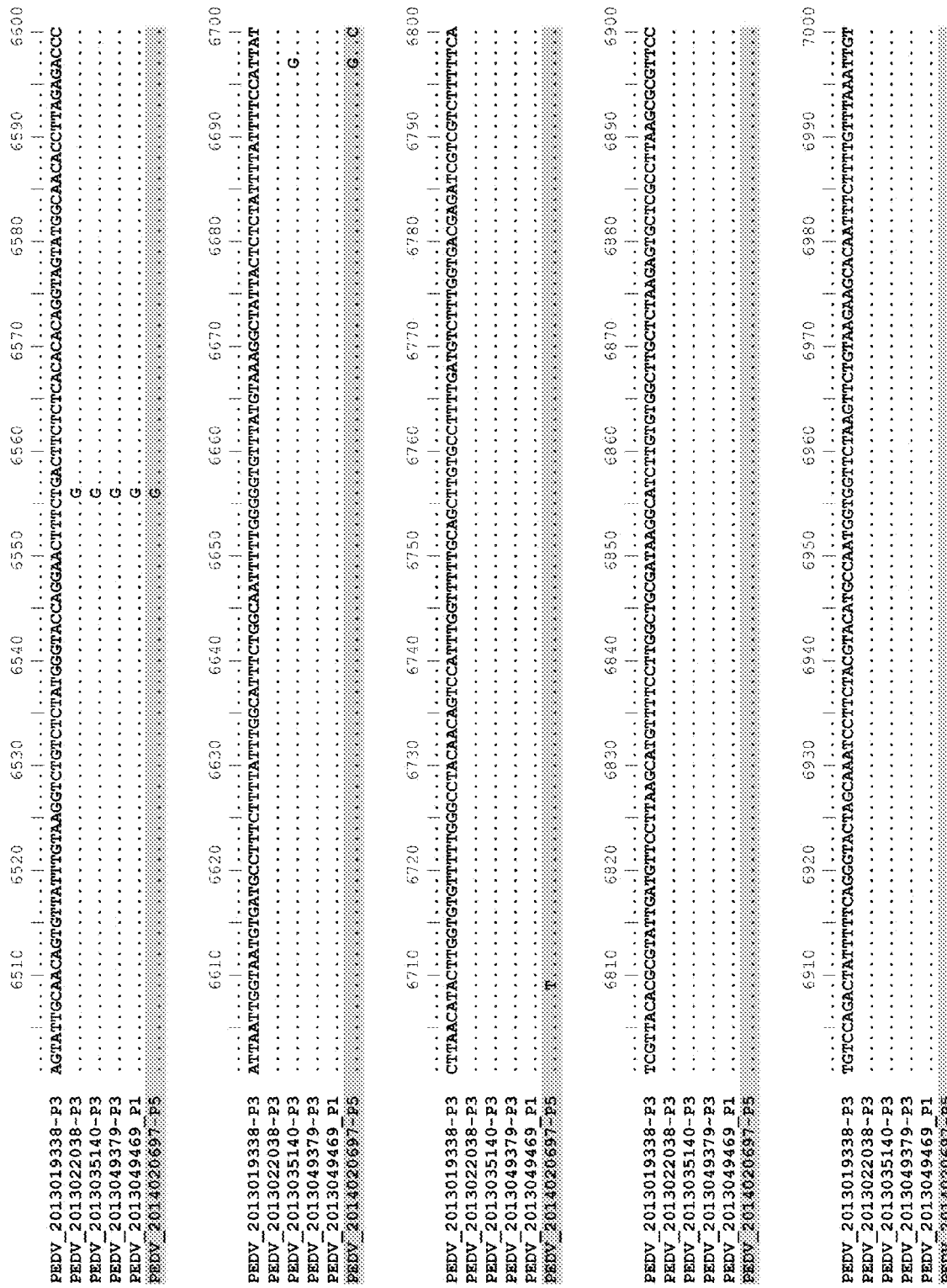
Figure 50:
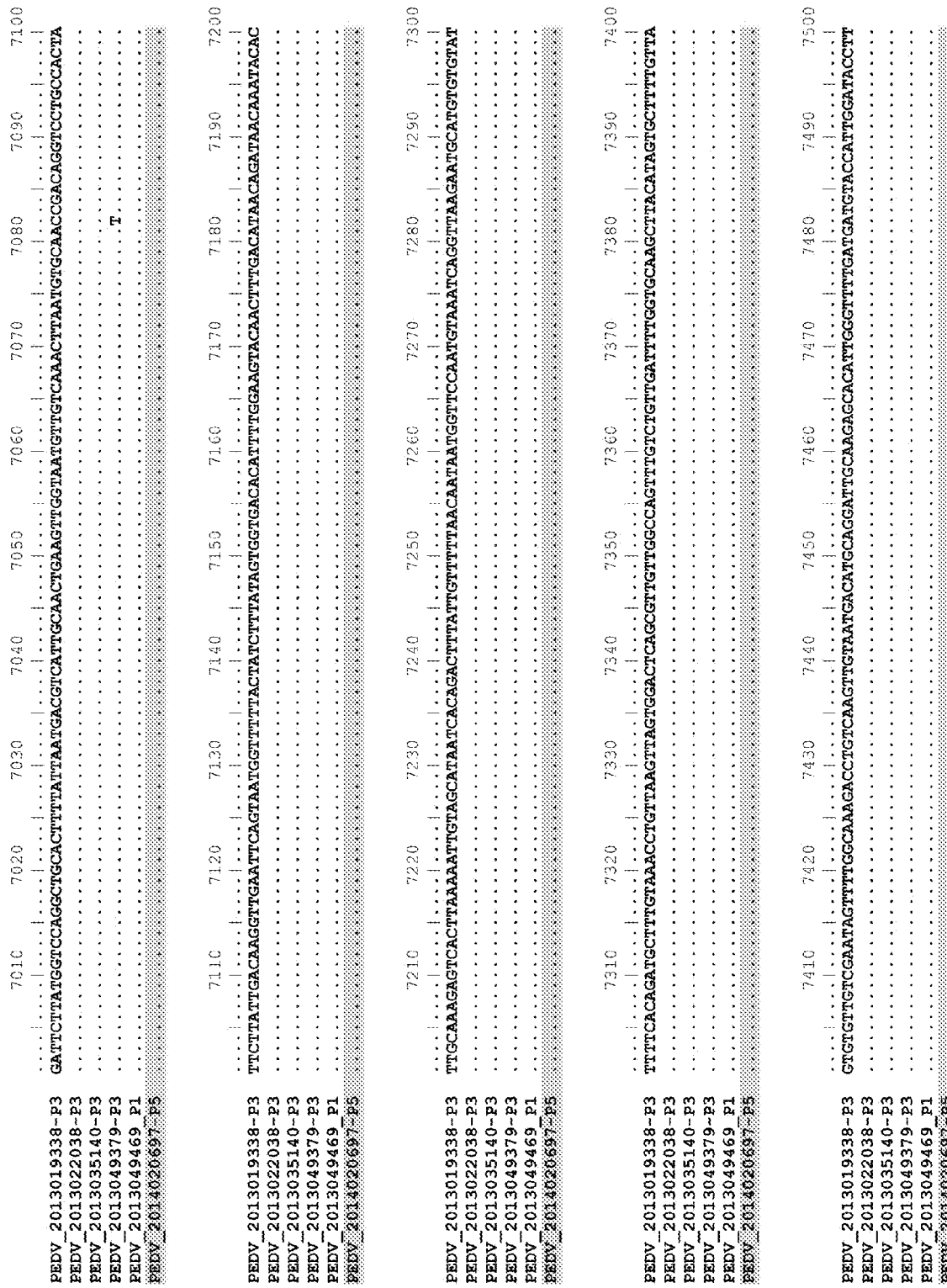
Figure 5P:
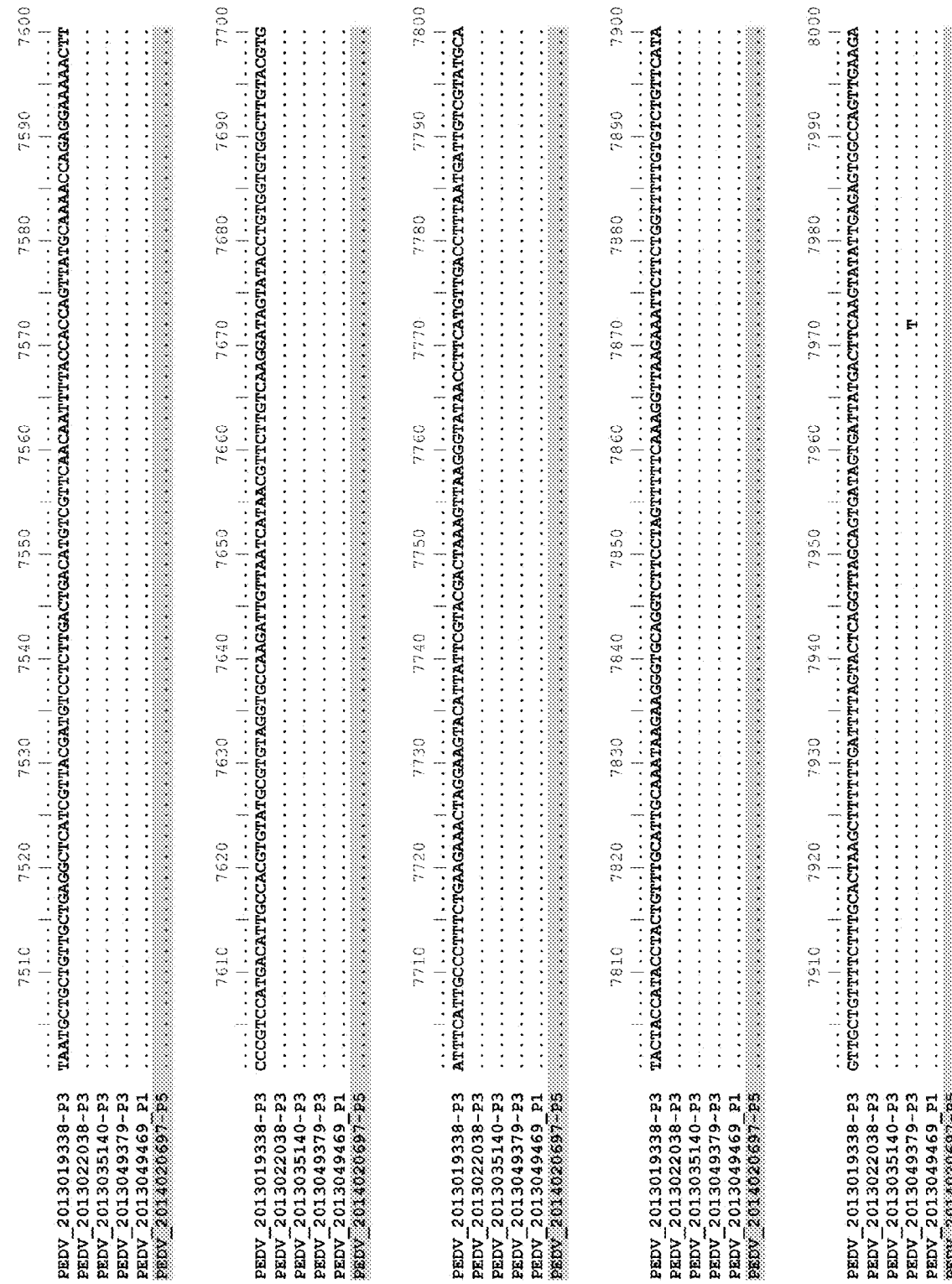
Figure 5Q:
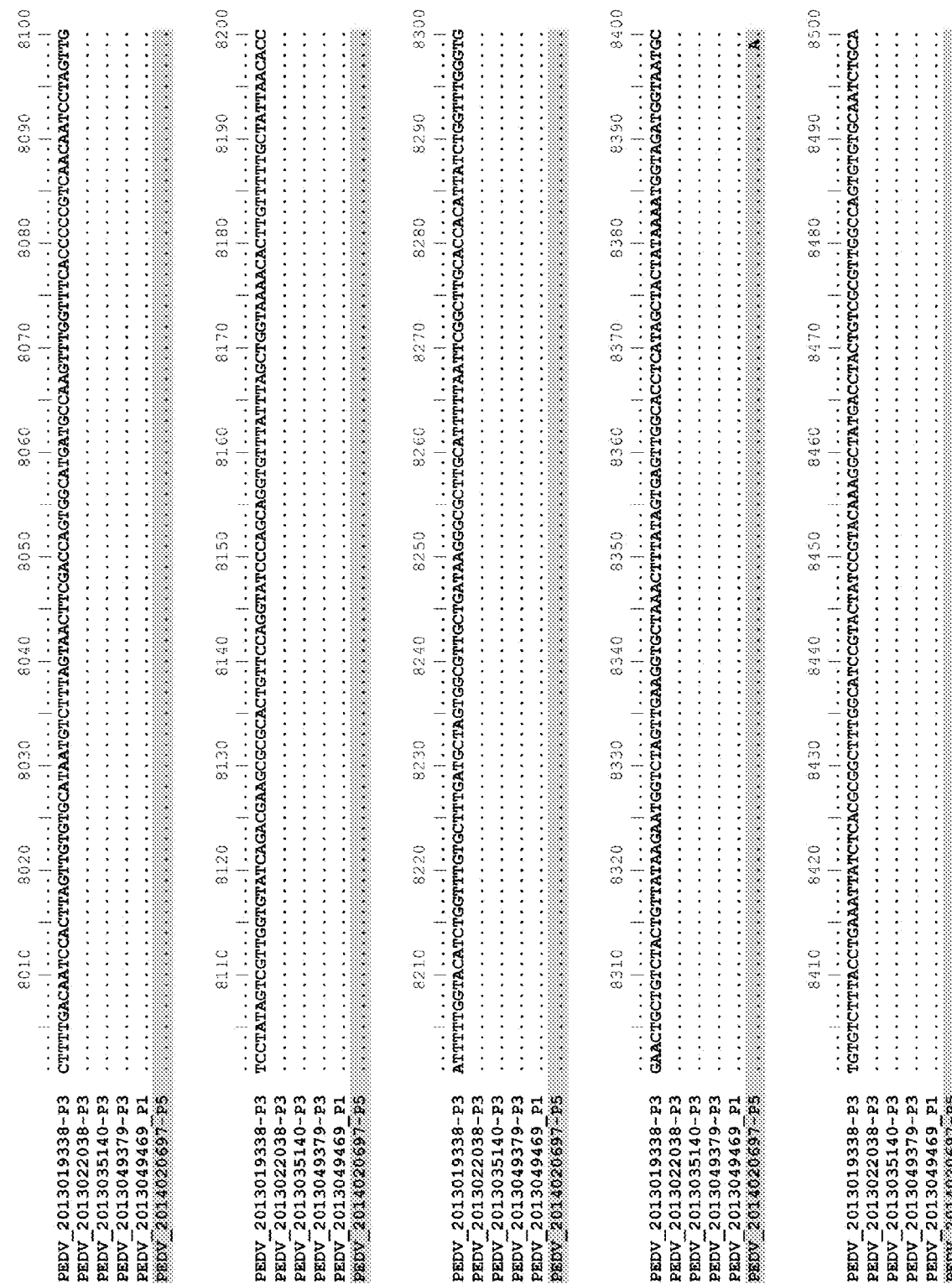
Figure 5R:
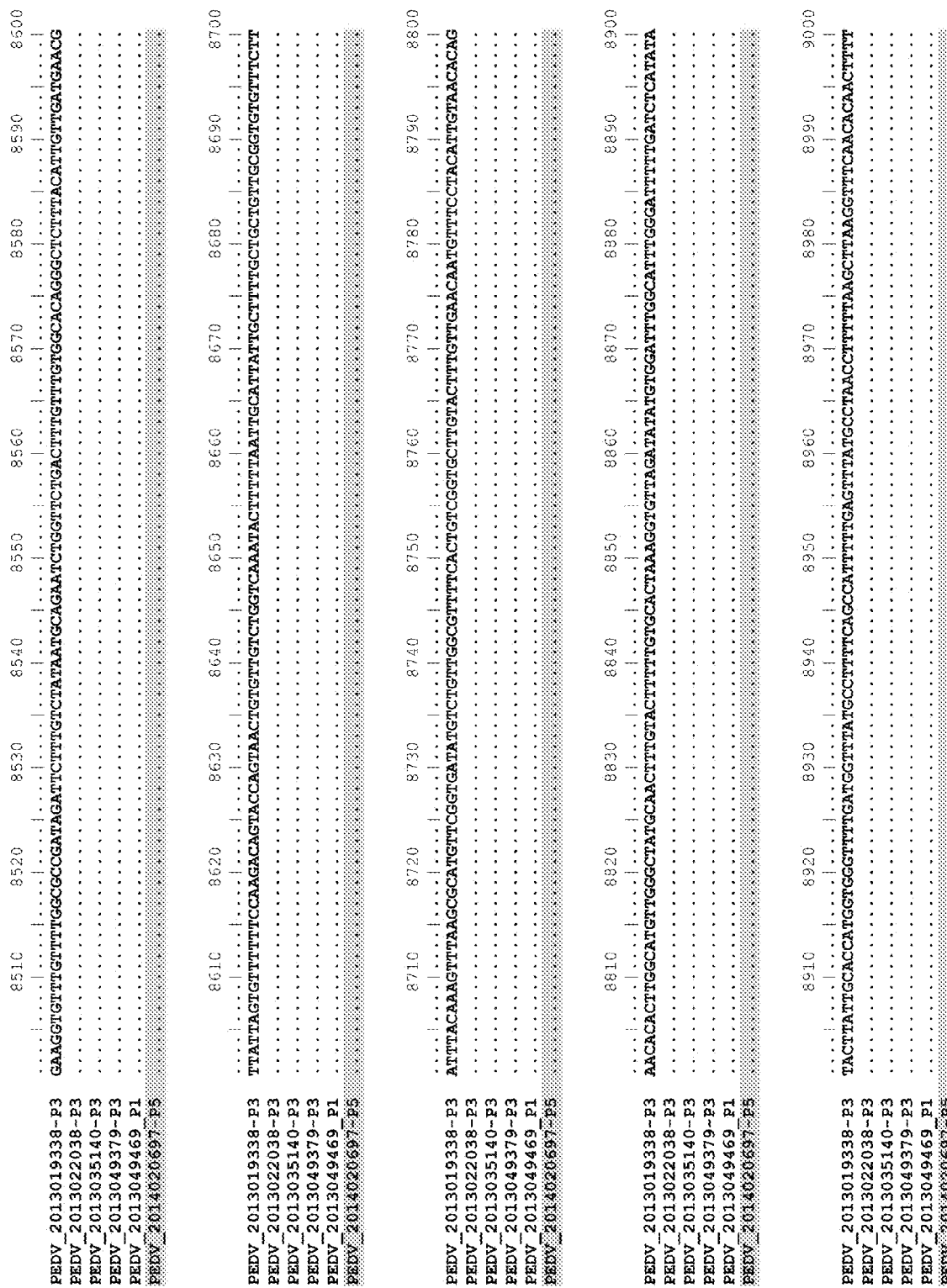
Figure 5U:
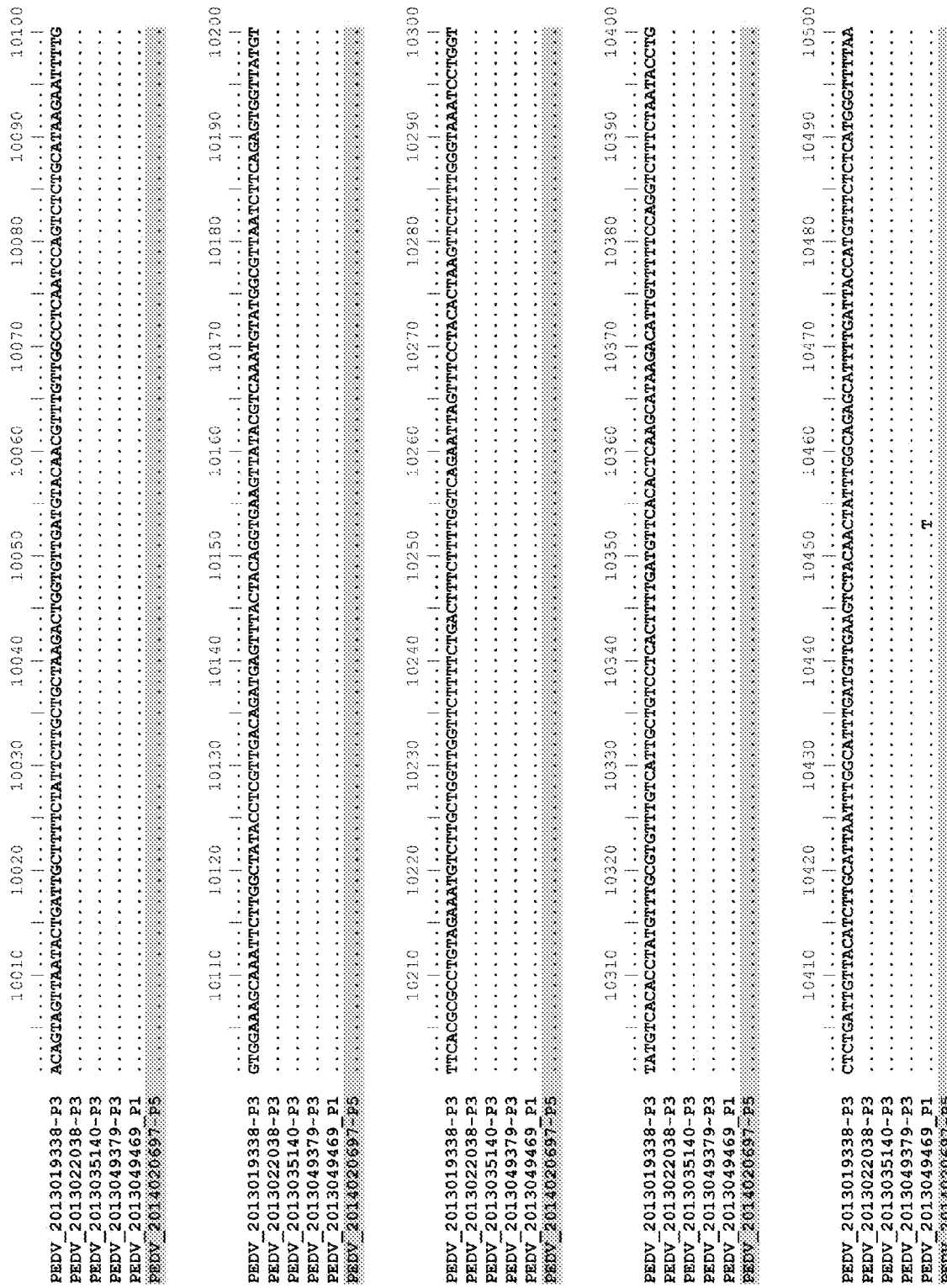
Figure 5V:
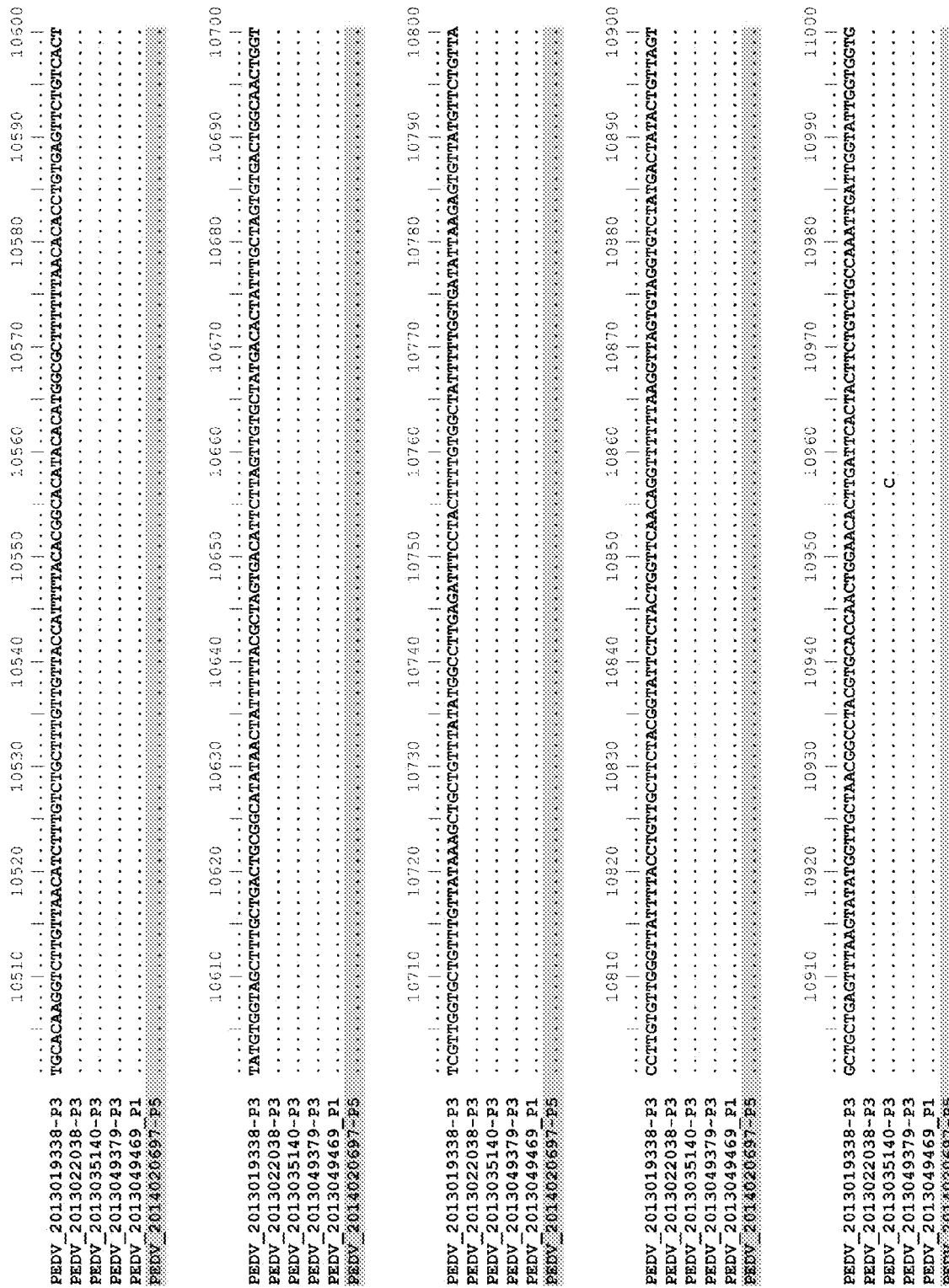
Figure 5W:
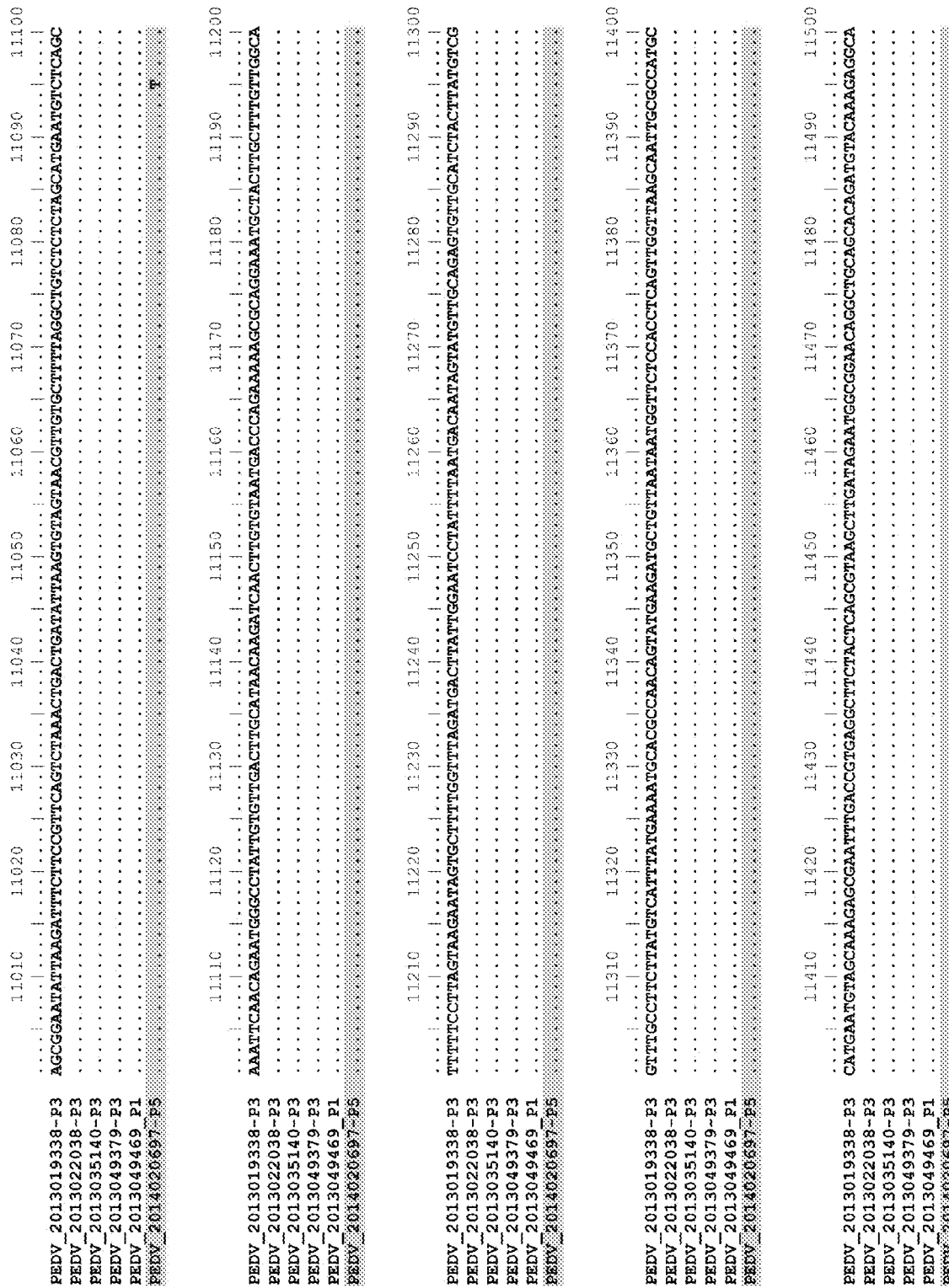
Figure 5X:
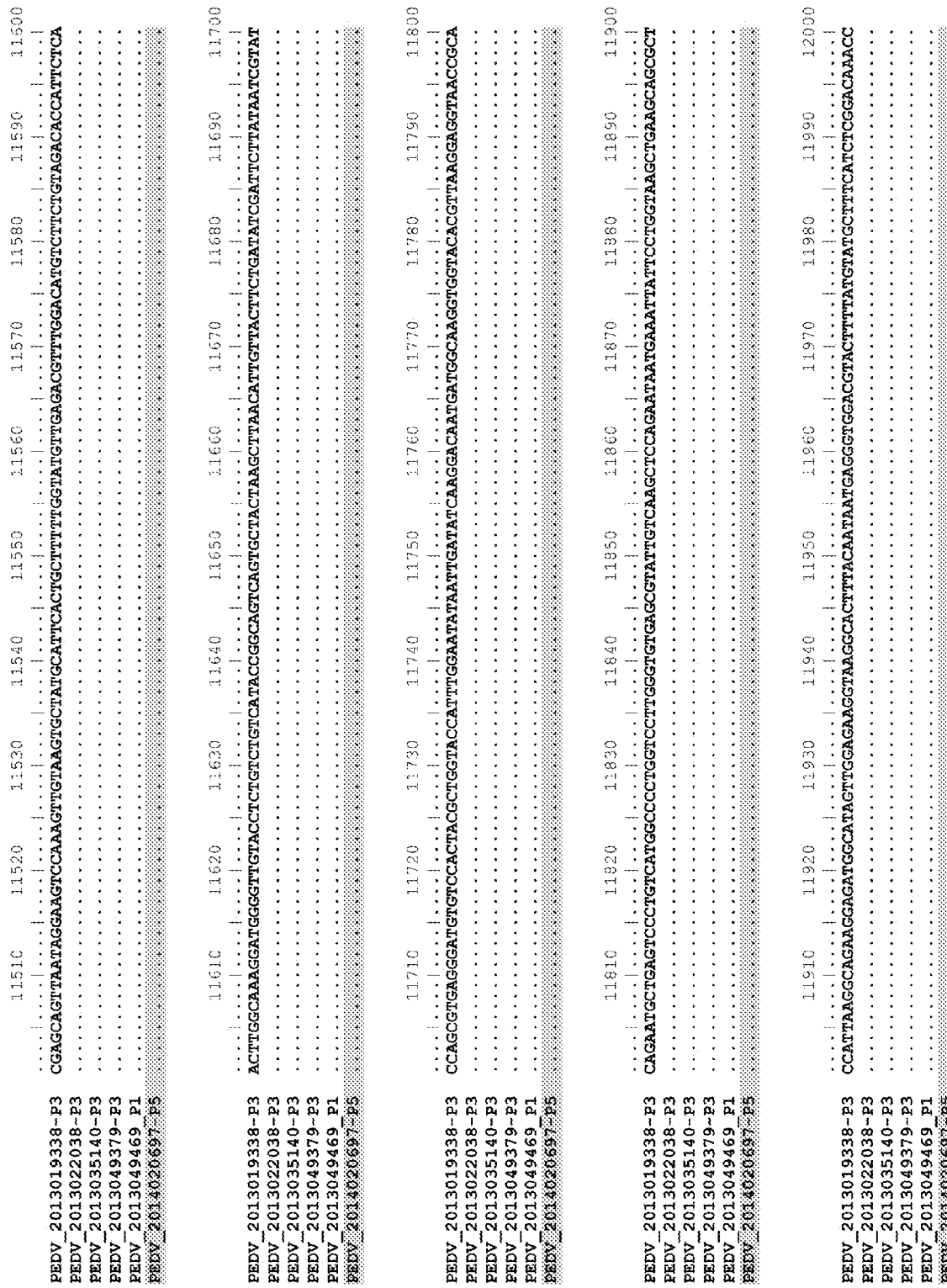
Figure 5Y:
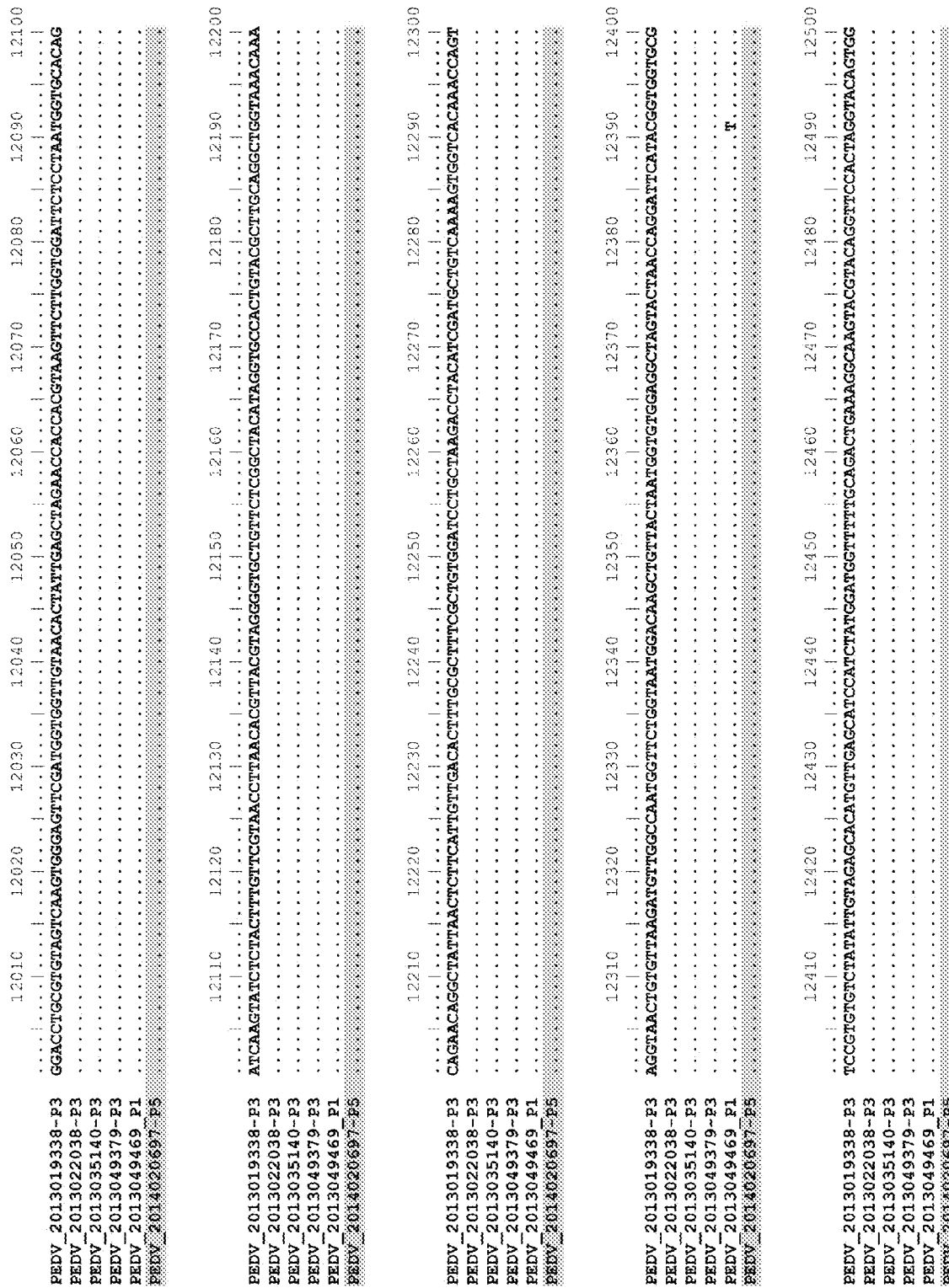
Figure 5Z:
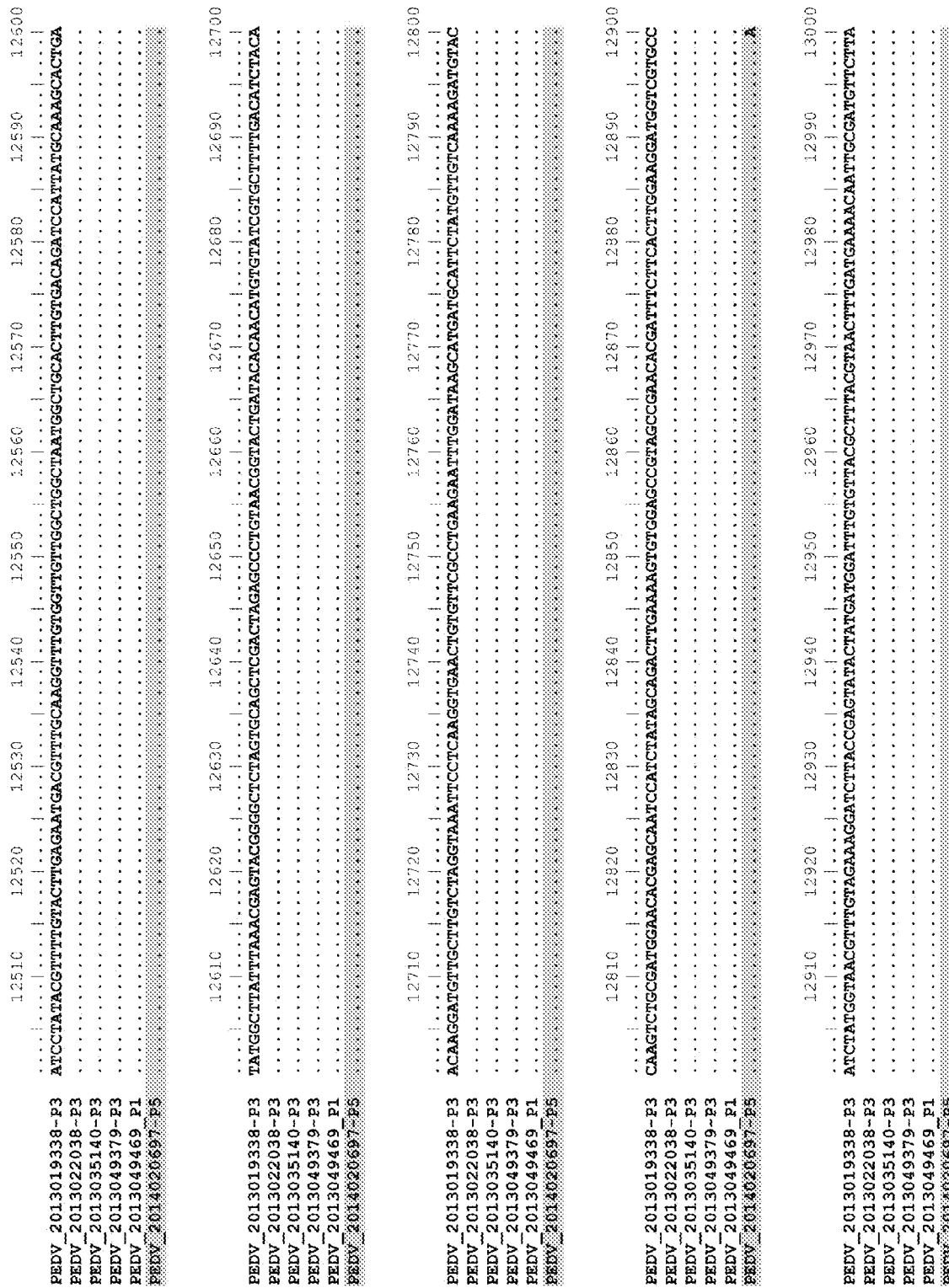
Figure 5A:
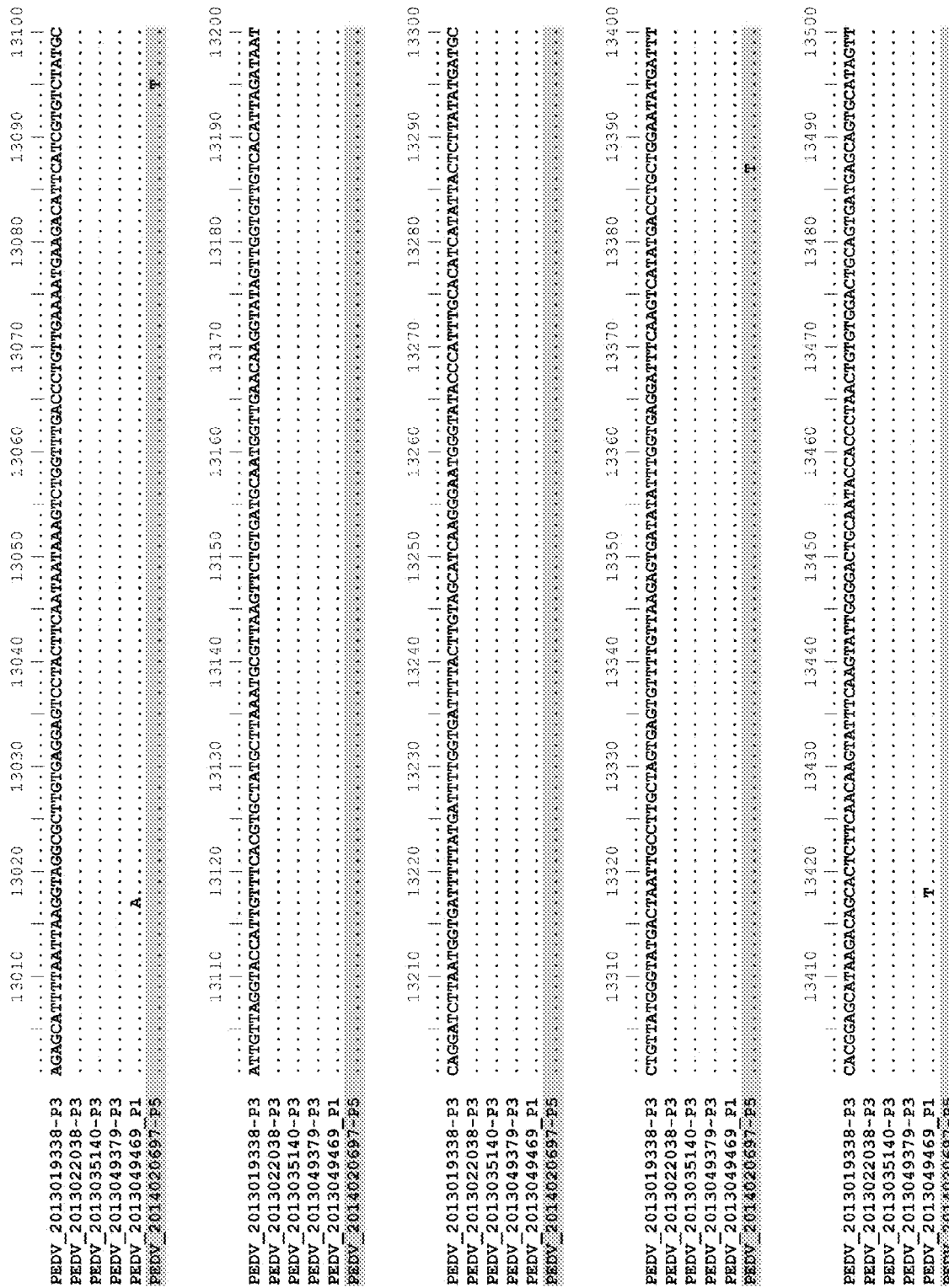
Figure 5B:
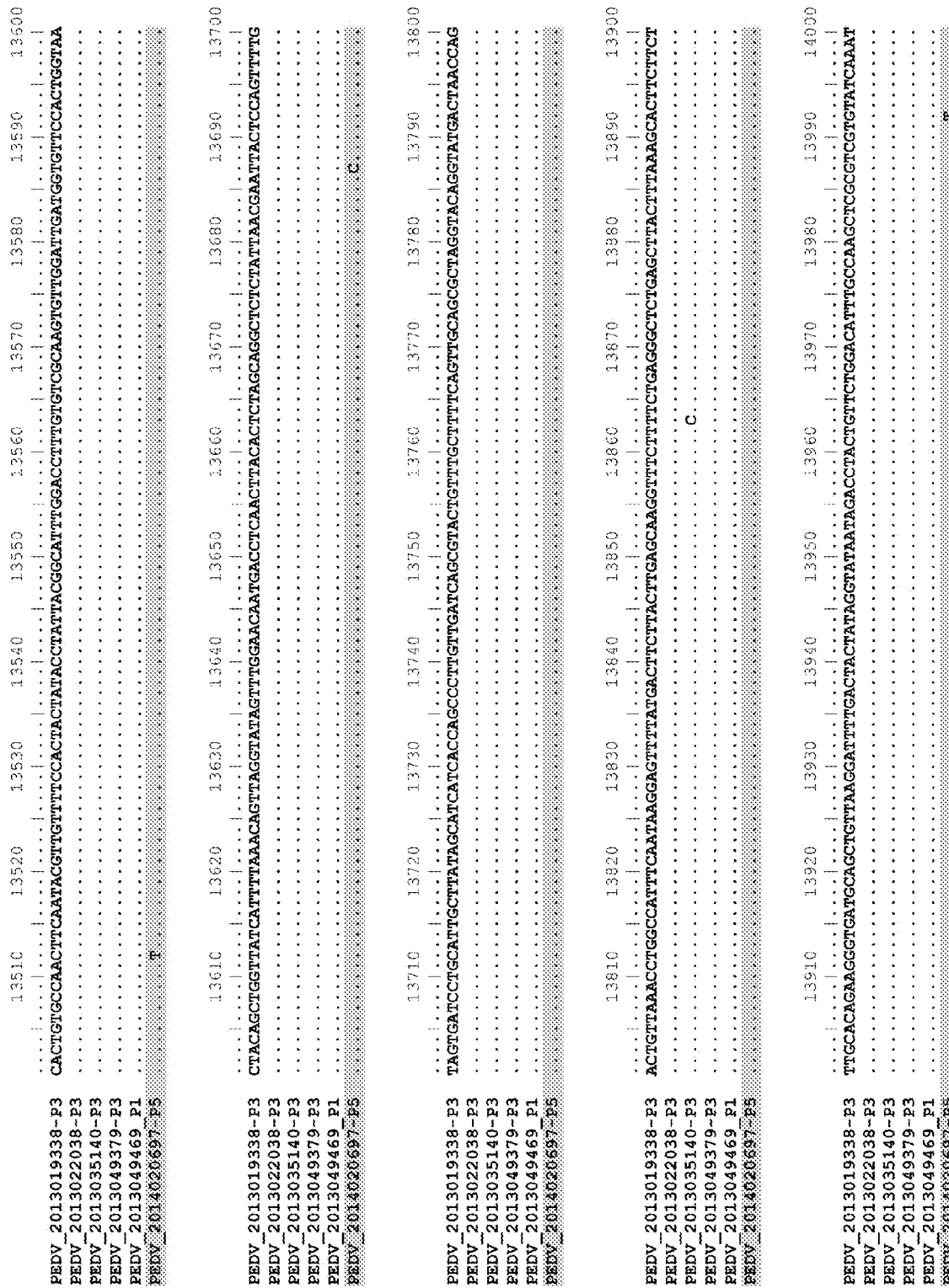
Figure 5C:
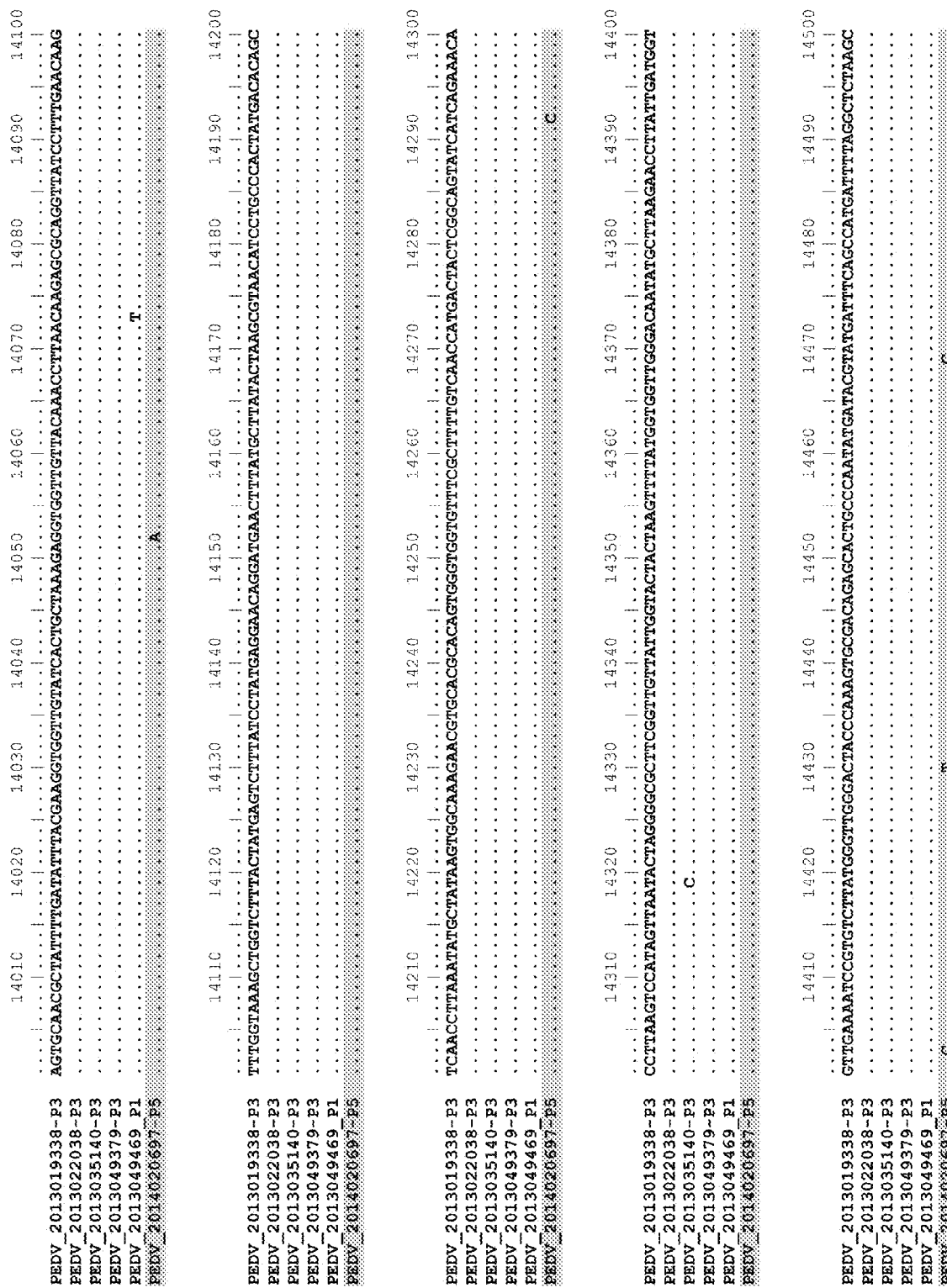
Figure 5D:
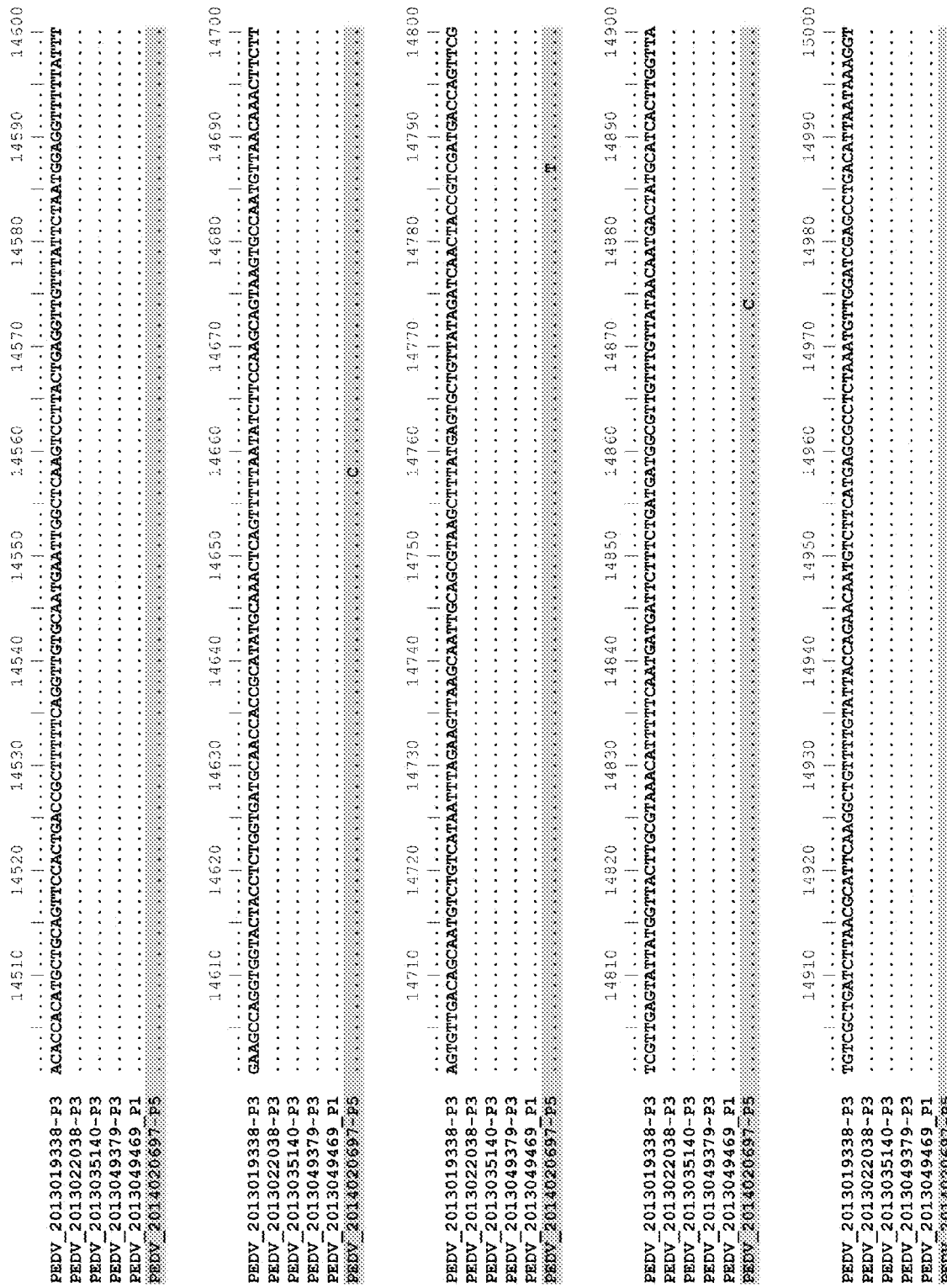
Figure 5E:
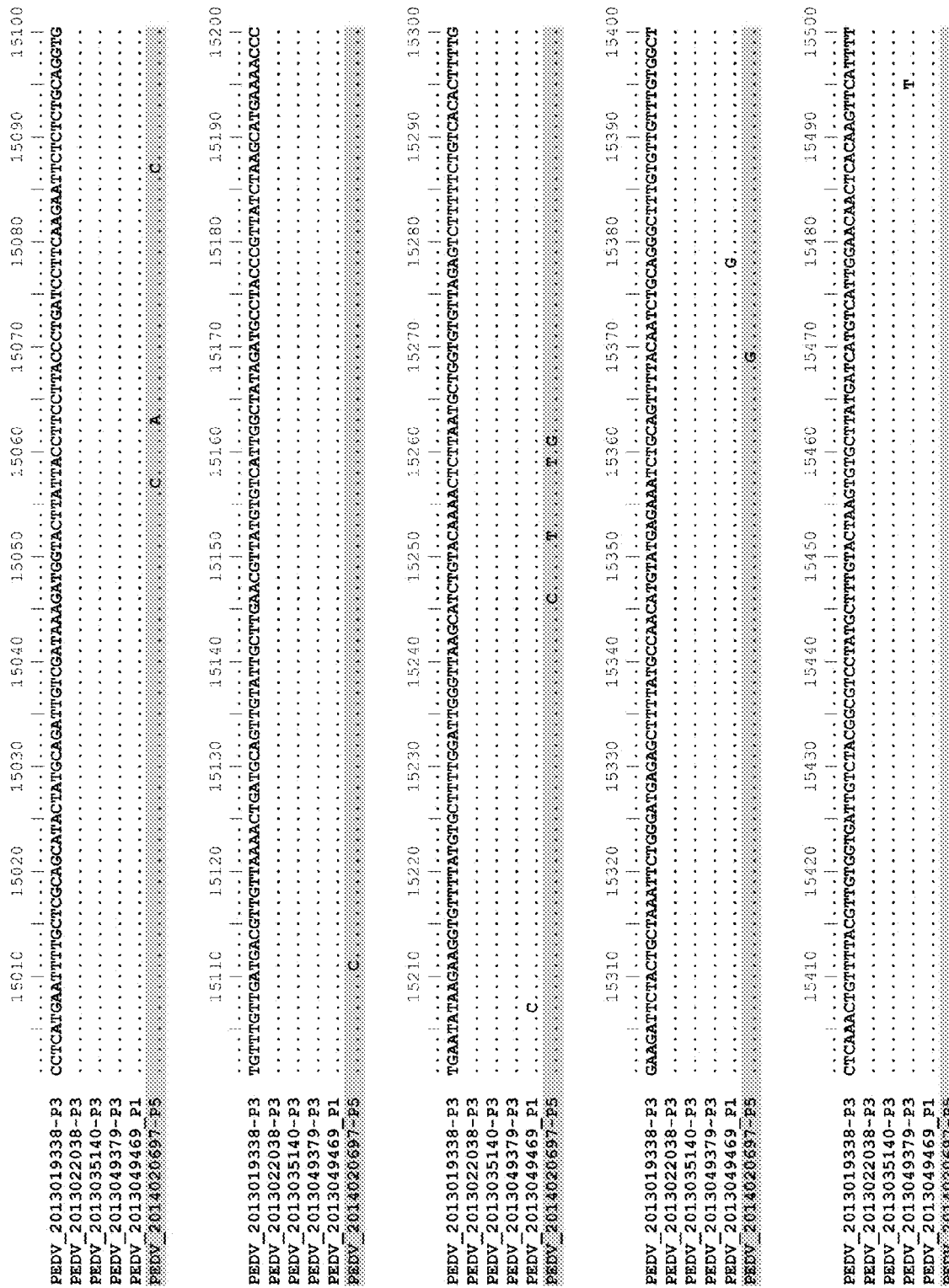
Figure 5G:
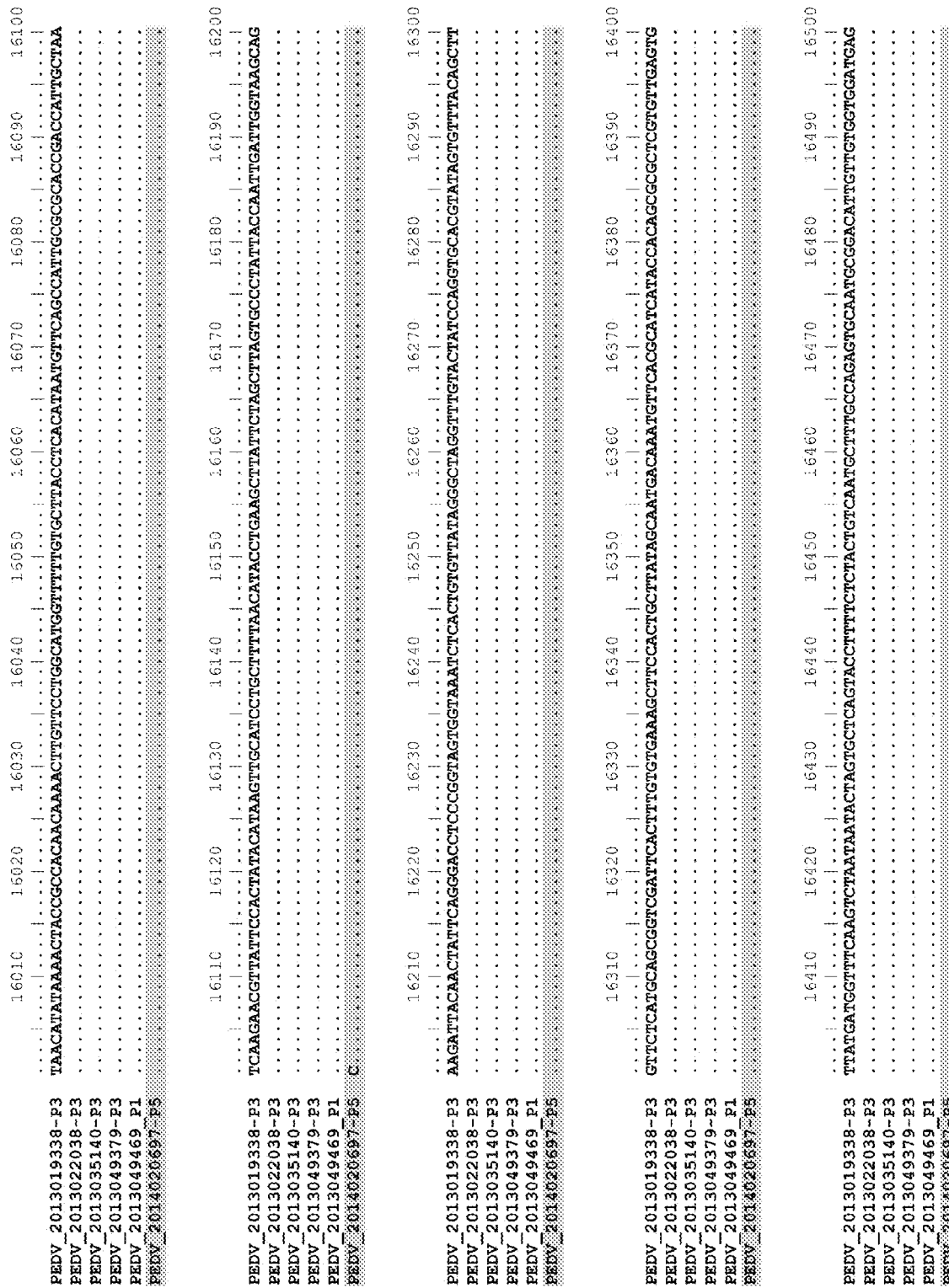
Figure 5L:
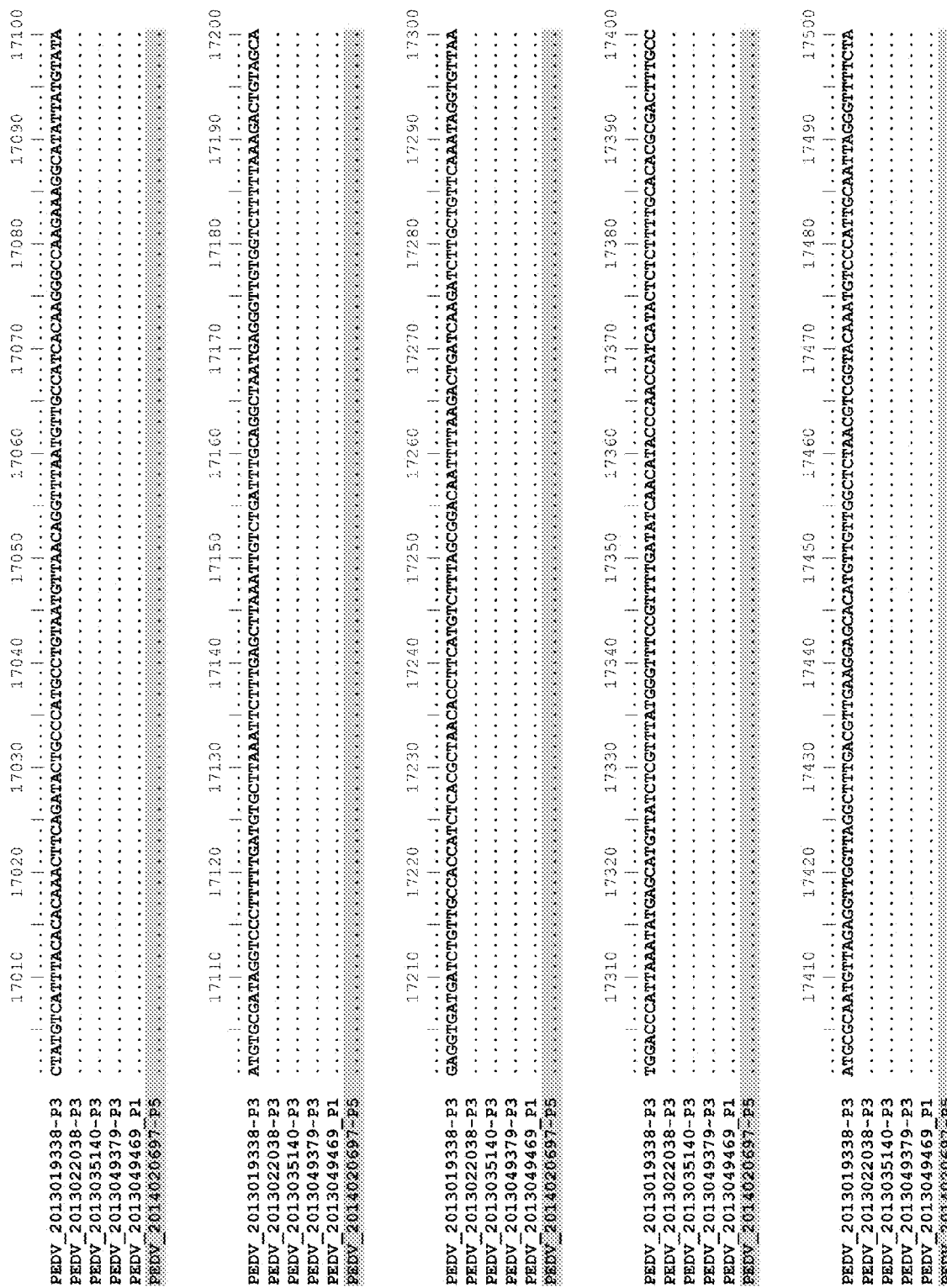
Figure 5K:
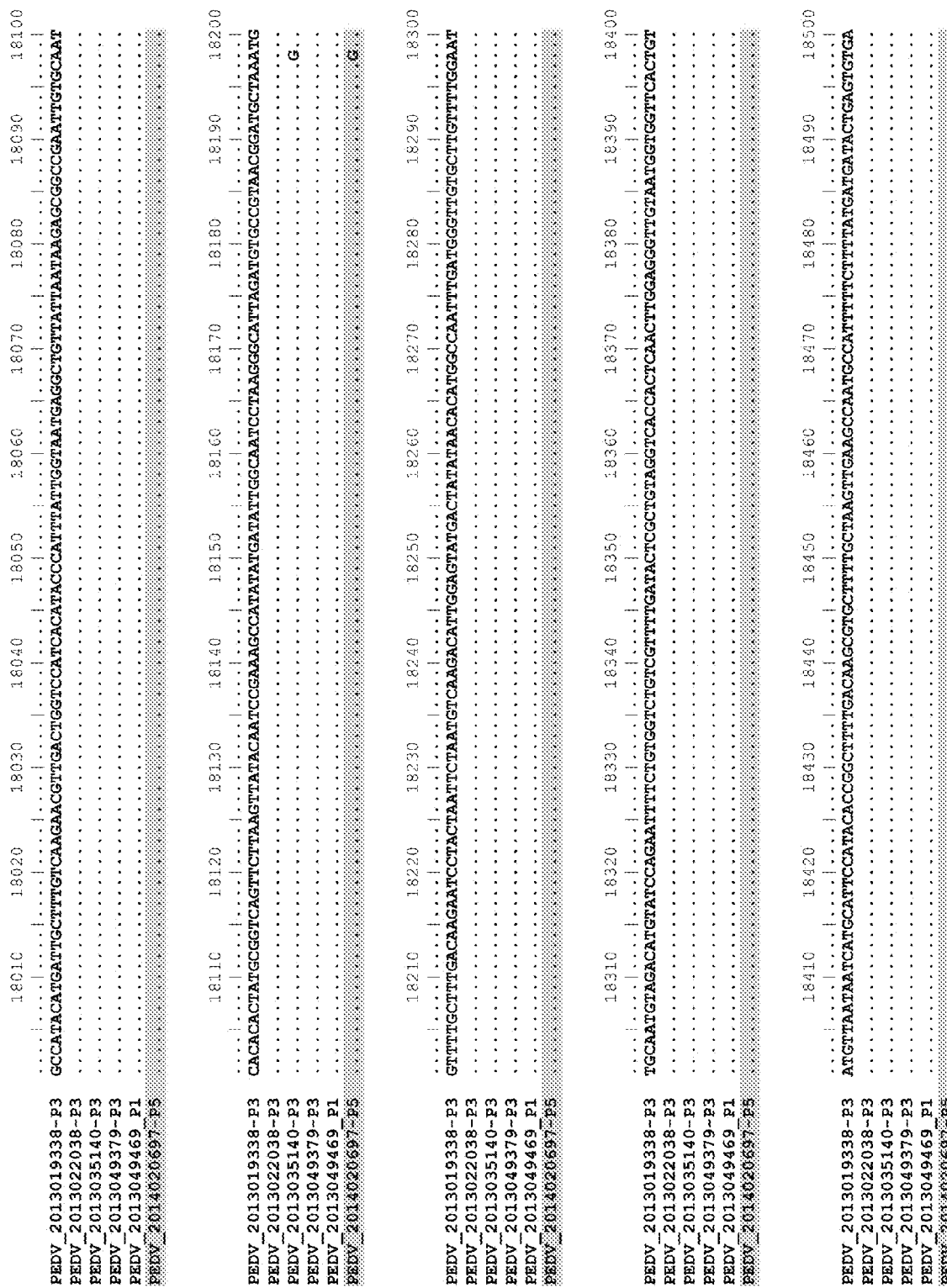
Figure 5L:
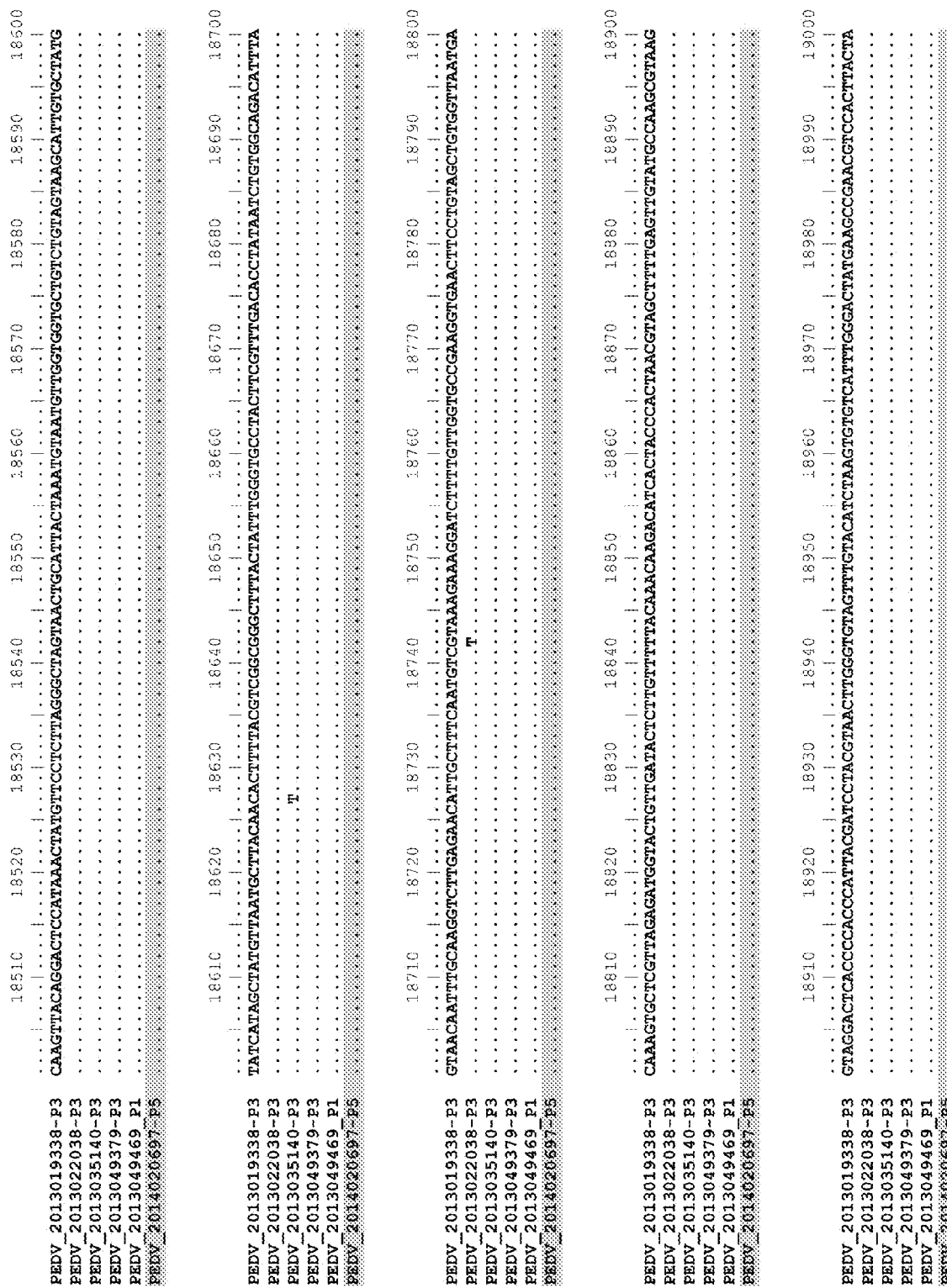
Figure 5M:
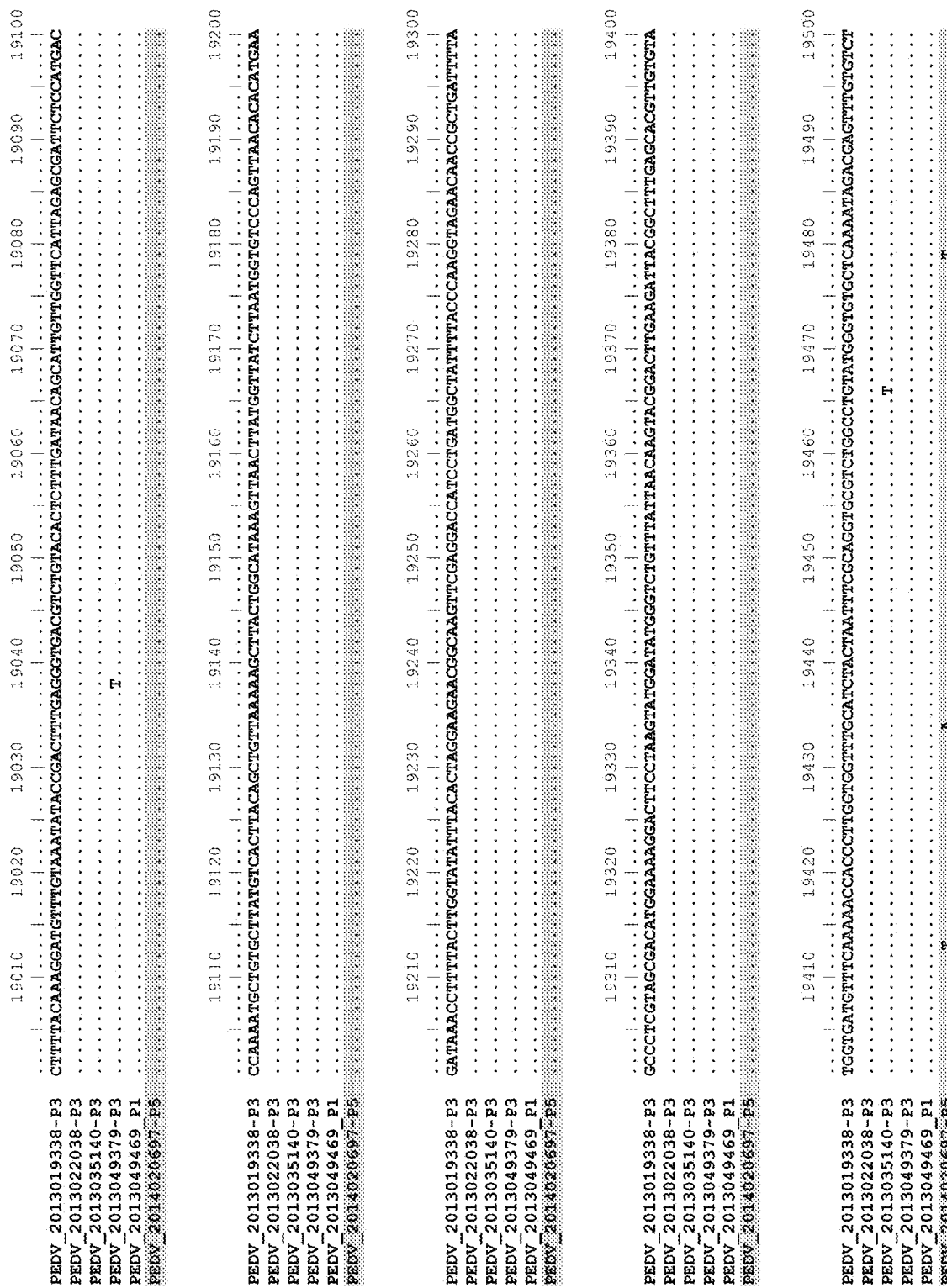
Figure 5N:
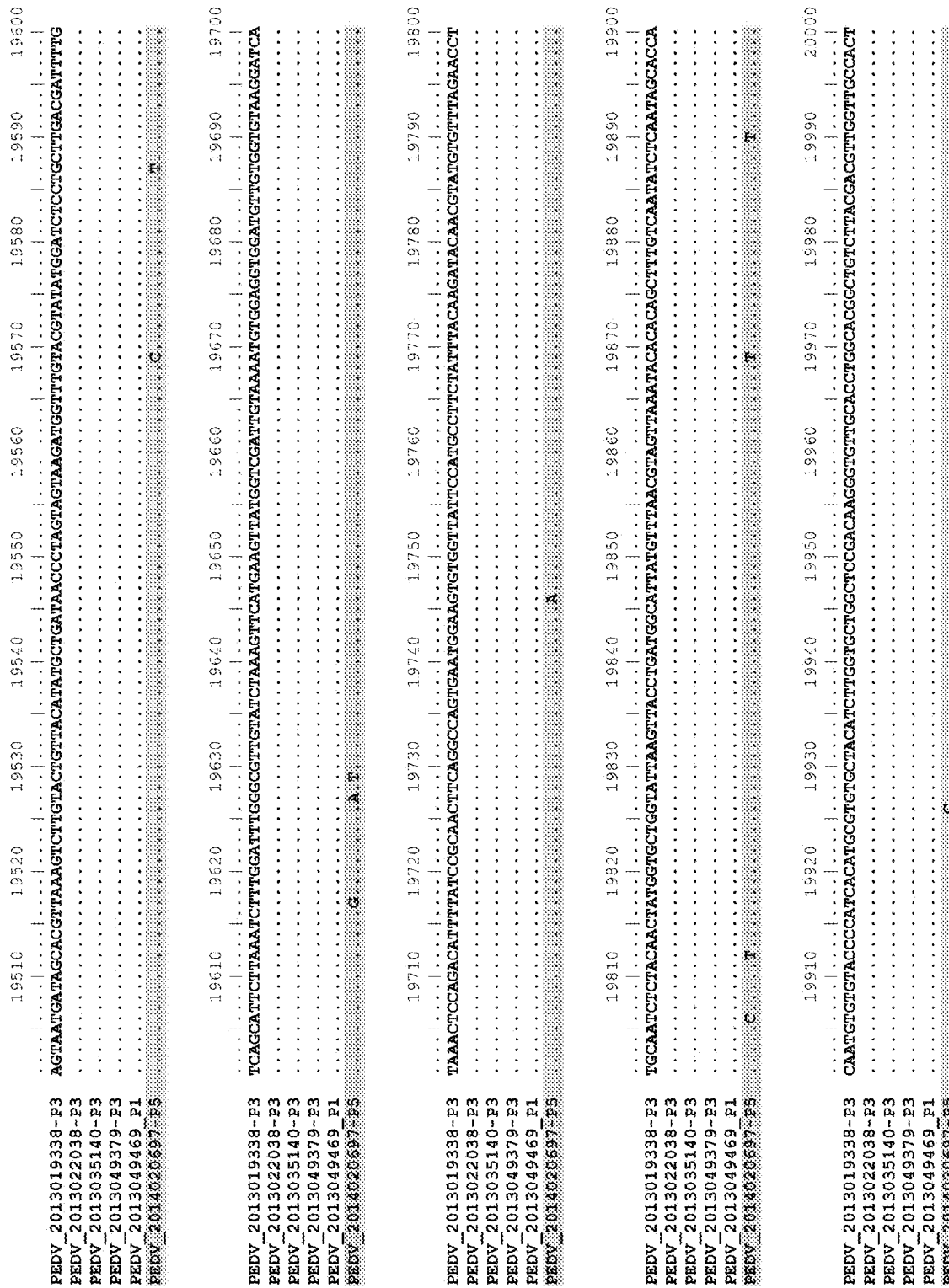
Figure 50O:
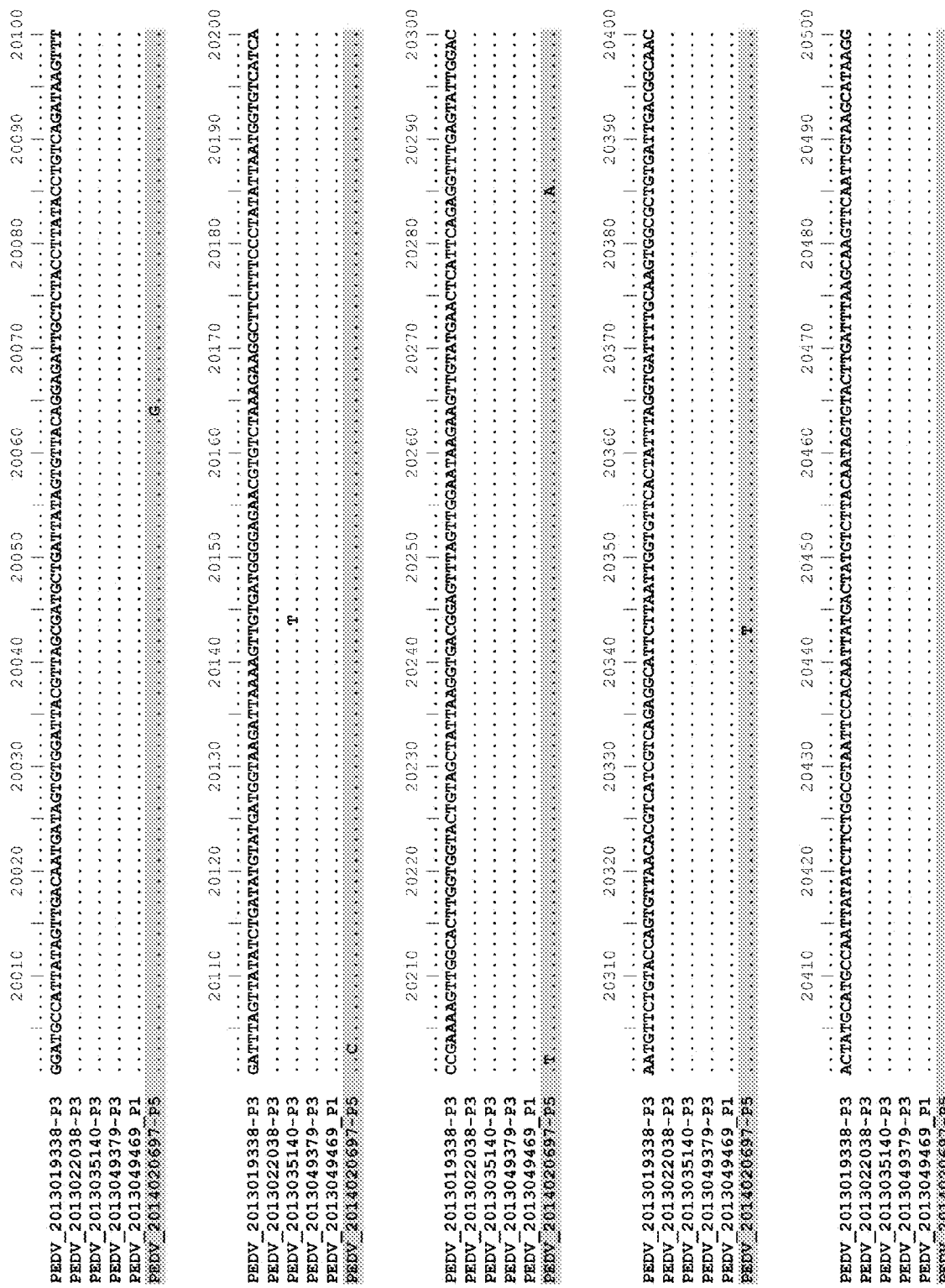
Figure 5Q:
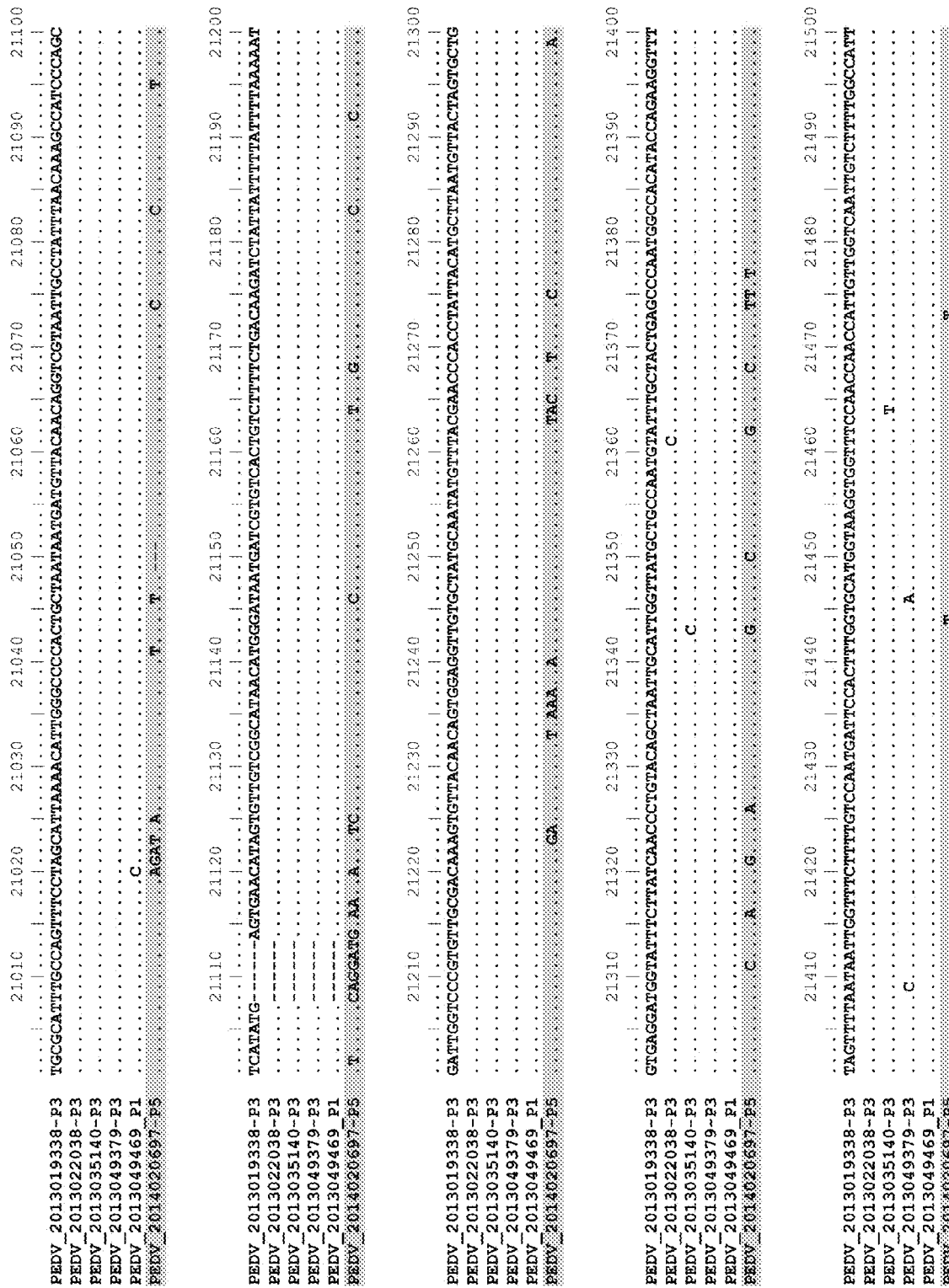
Figure 5R:
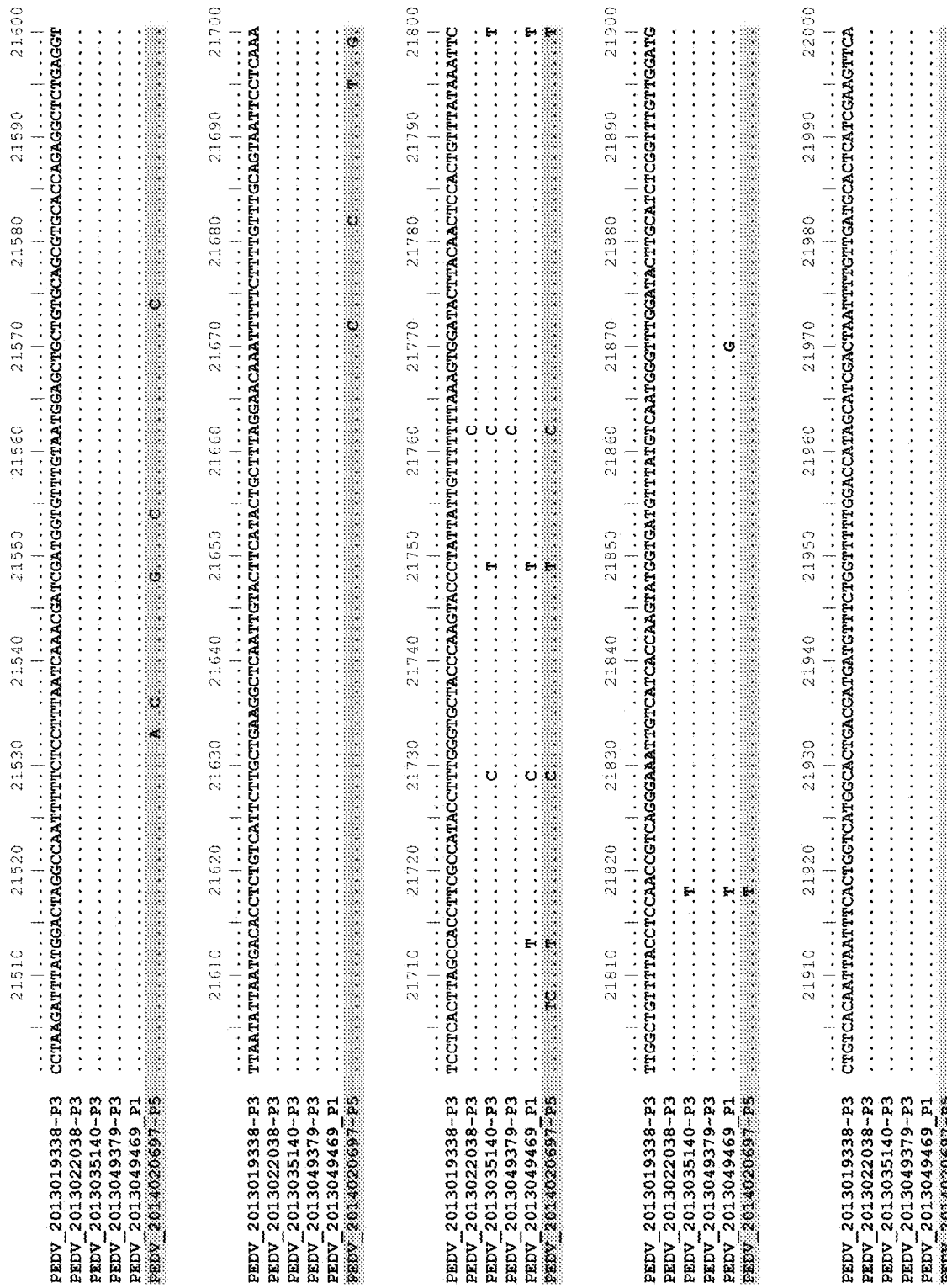
Figure 5S:
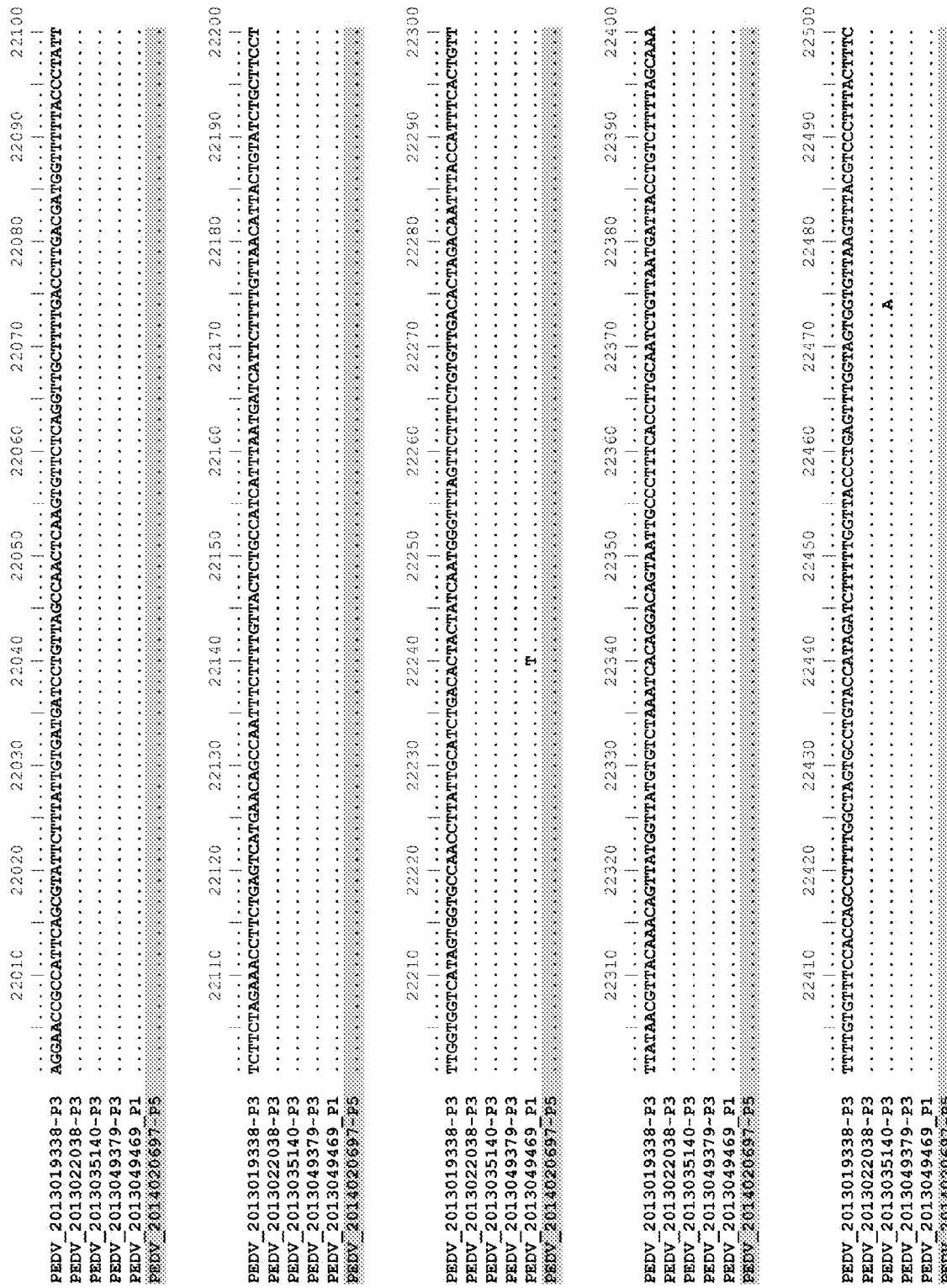
Figure 5T:
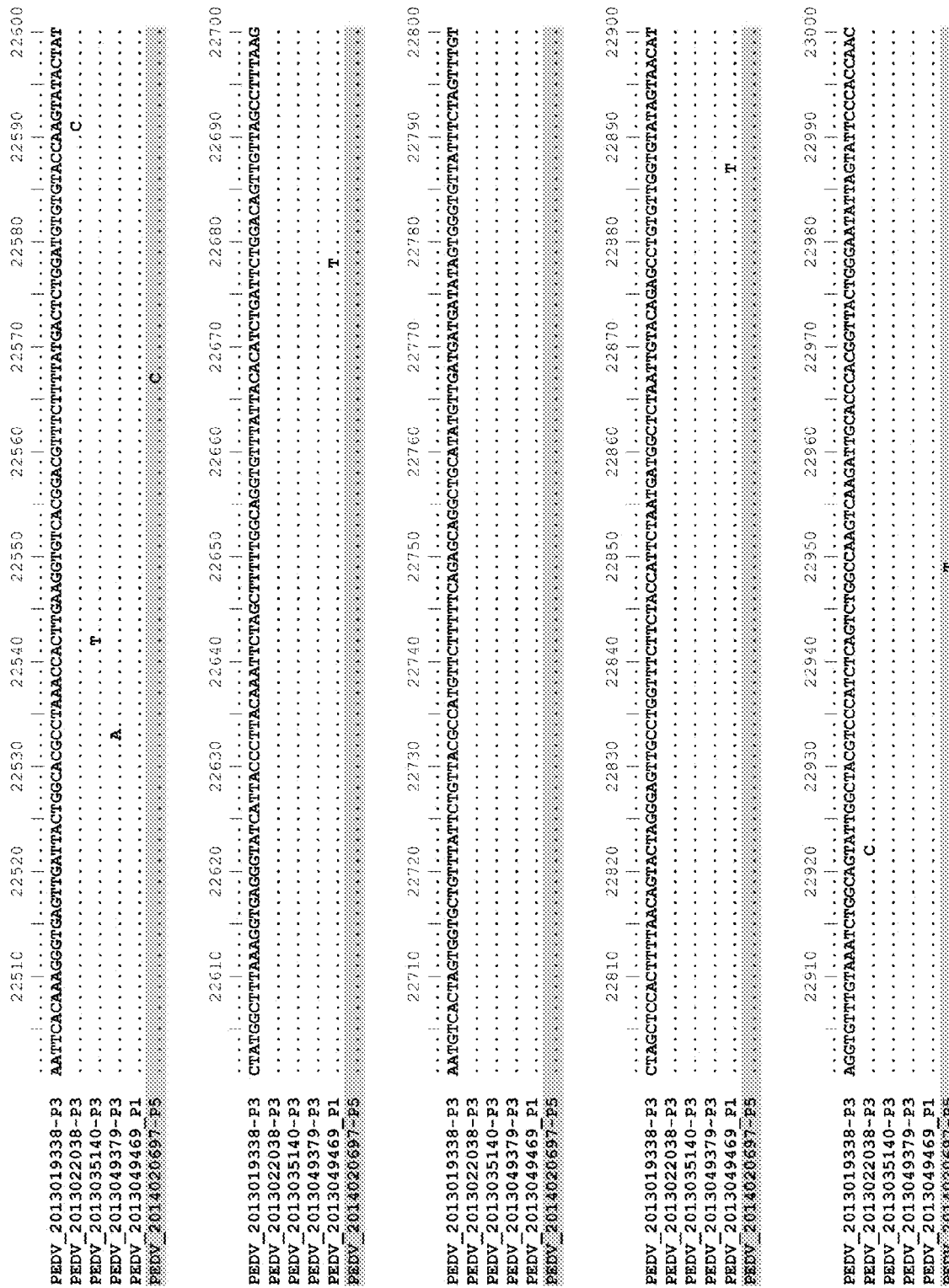
Figure 5U:
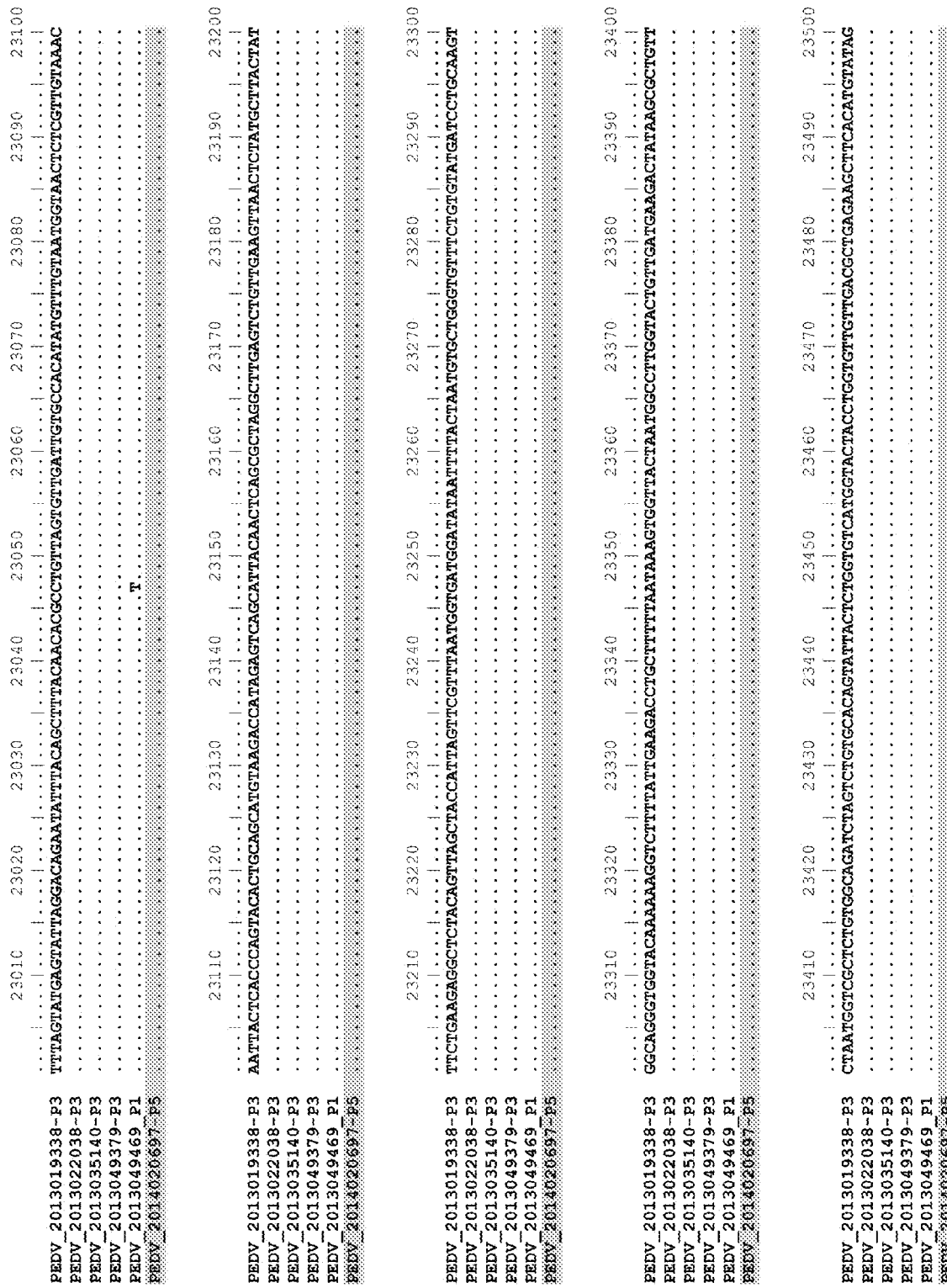
Figure 5V:
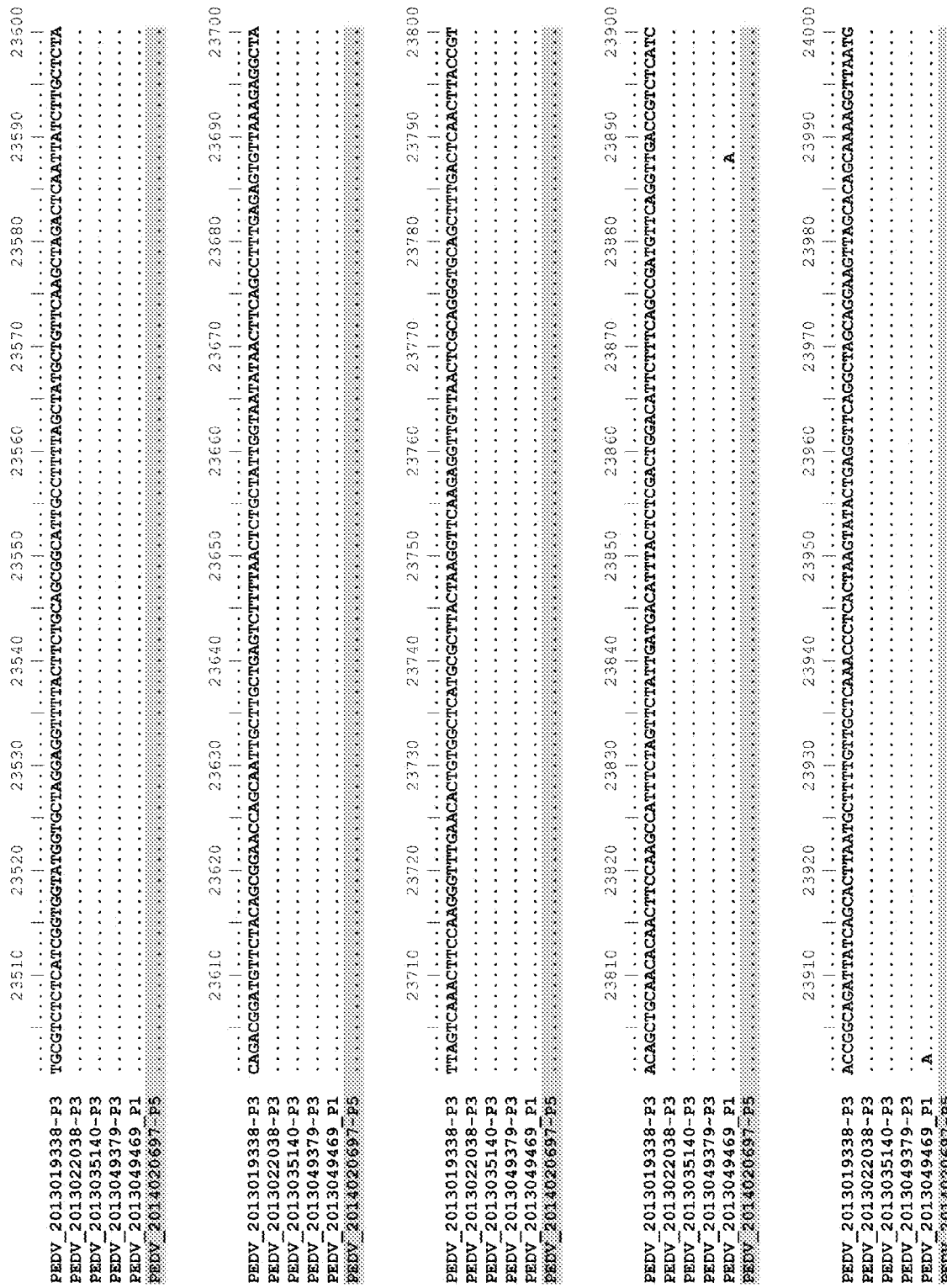
Figure 5W:
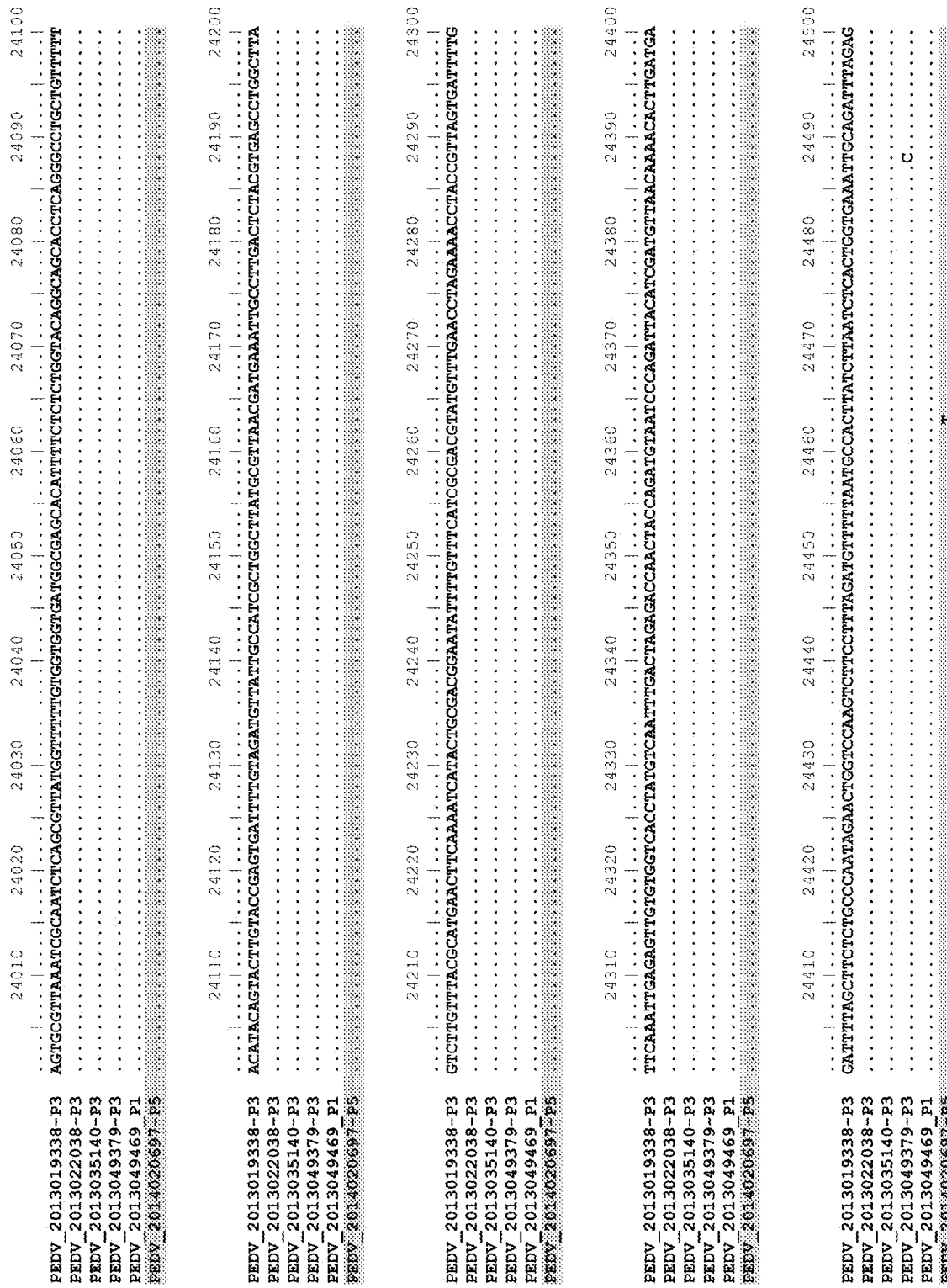
Figure 5X:
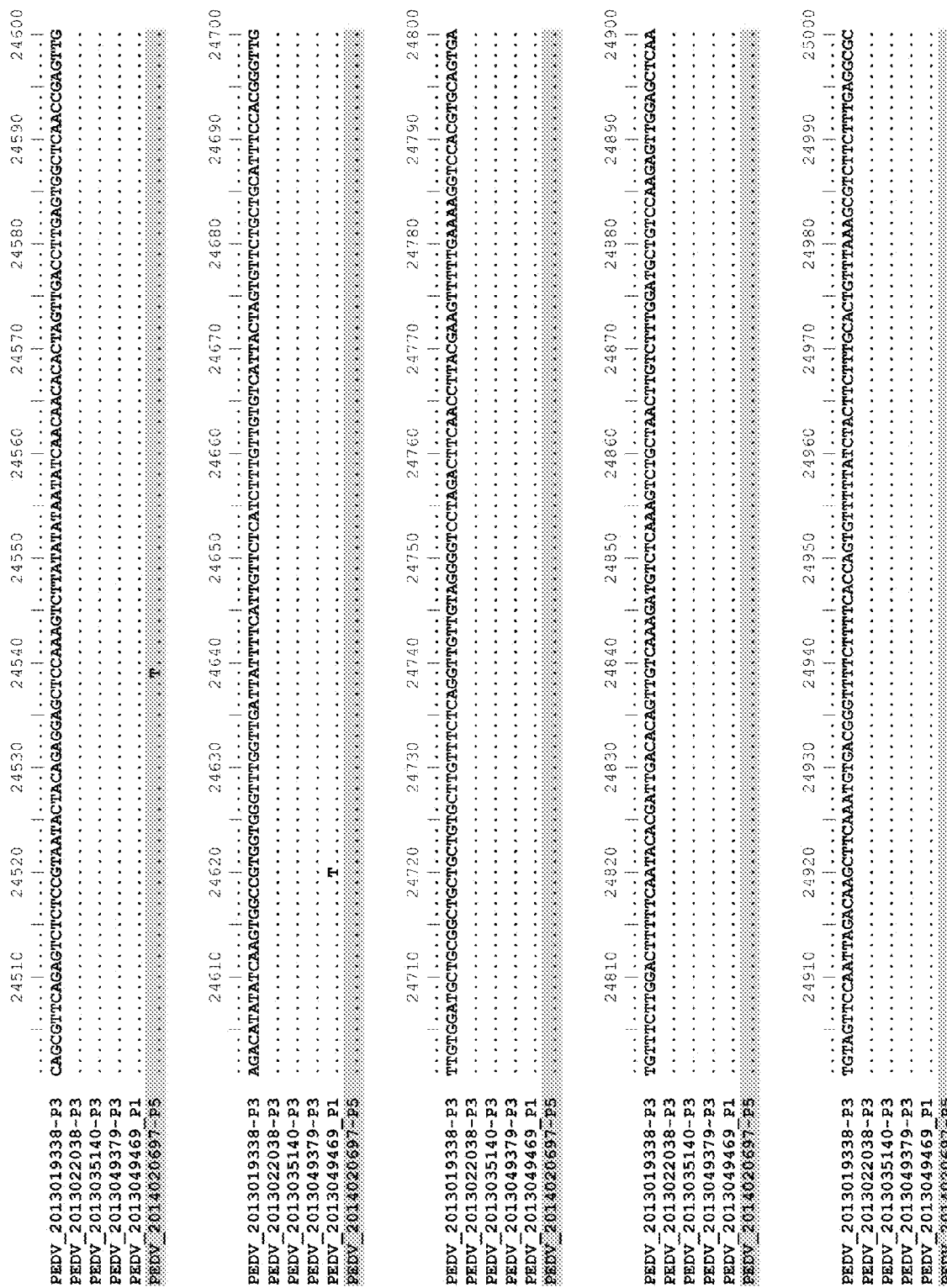
Figure 5Y:
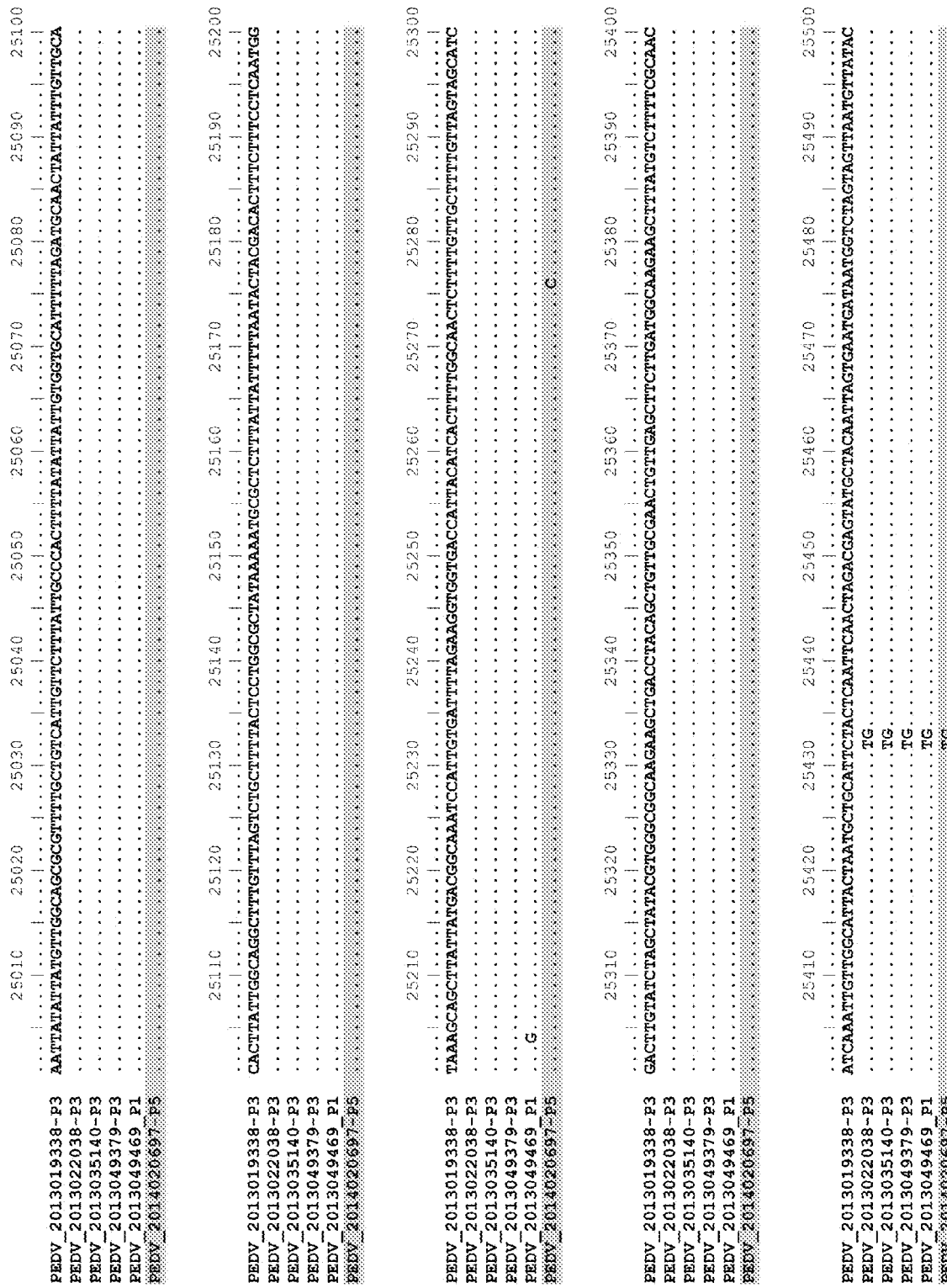
Figure 5Z:
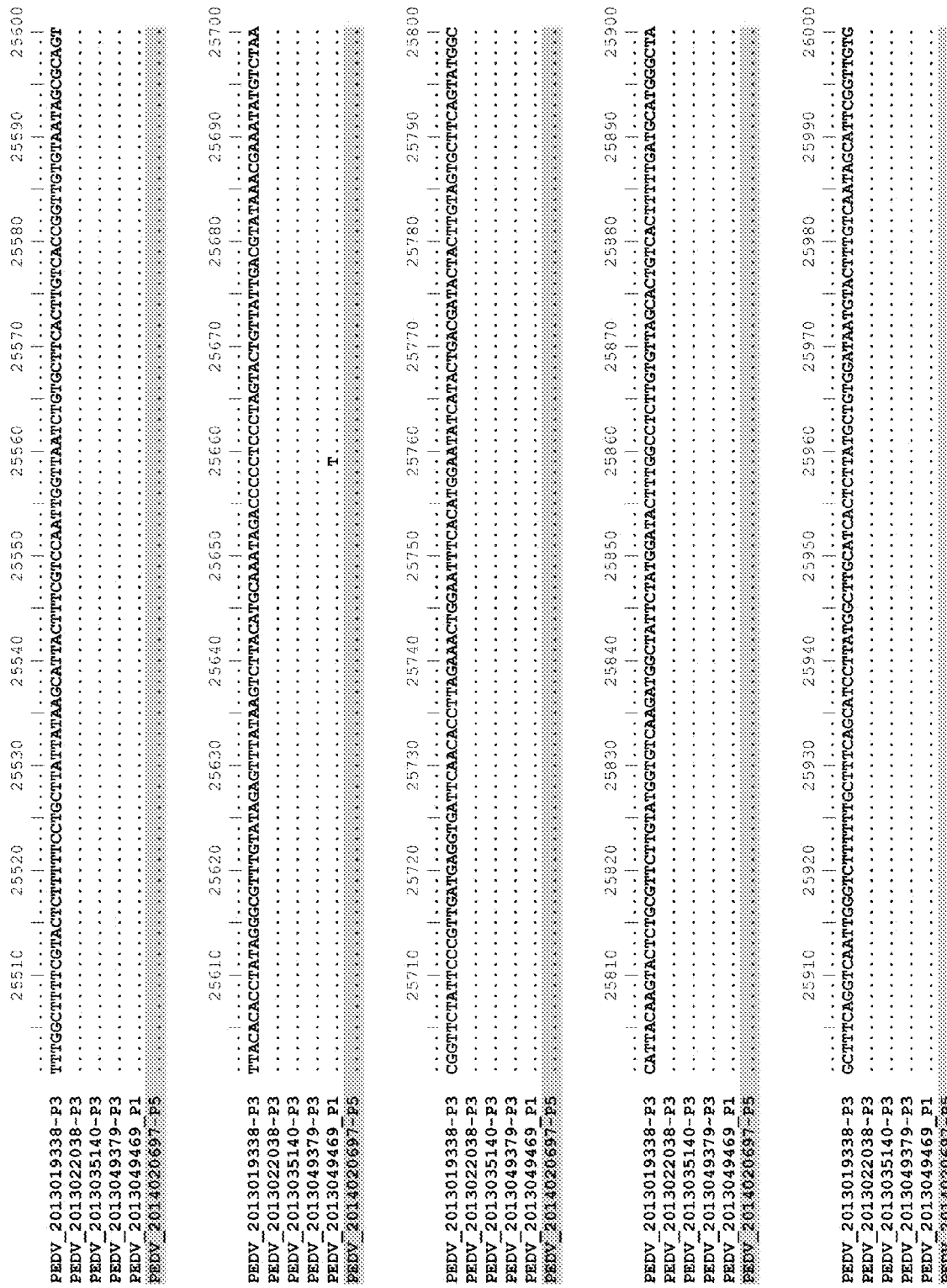

FIG. 2 shows phylogenetic trees based on the S1 portion sequences and the whole genome sequences. See the attachment. One can see that, in addition to in US swine, the US prototype-like strains have been detected in South Korea, Canada and Mexico; the US variant-INDEL-like strains have been detected in South Korea, Mexico and Germany.

Example 2

At least two genetically different porcine epidemic diarrhea virus (PEDV) strains have been identified in the United States: U.S. PEDV prototype and S-INDEL-variant strains. The objective of this study was to compare the pathogenicity differences of the U.S. PEDV prototype and S-INDEL-variant strains in conventional neonatal piglets under experimental infections. Fifty PEDV-negative 5-day-old pigs were divided into 5 groups of 10 pigs each and were inoculated orogastrically with three U.S. PEDV prototype isolates (IN19338/2013-P7, NC35140/2013-P7, and NC49469/2013-P7), an S-INDEL-variant isolate (2014020697-P7), and virus-negative culture medium, respectively, with virus titers of $10^4$ TCID50/ml, 10 ml per pig. All three PEDV prototype isolates tested in this study, regardless of their phylogenetic clades, had similar pathogenicity and caused severe enteric disease in 5-day-old pigs as evidenced by clinical signs, fecal virus shedding, and gross and histopathological lesions. Compared to pigs inoculated with the three U.S. PEDV prototype isolates, pigs inoculated with the S-INDEL-variant isolate had significantly diminished clinical signs, virus shedding in feces, gross lesions in small intestines, ceca and colons, histopathological lesions in small intestines and immunohistochemistry staining in ileum. The U.S. PEDV prototype and the S-INDEL-variant strains induced similar viremia levels in inoculated pigs. Whole genome sequences of the PEDV prototype and S-INDEL-variant strains were determined but the molecular basis of virulence differences between these PEDV strains remains to be elucidated using reverse genetics approach. The present study provides a strong foundation to the understanding of the molecular mechanisms which contribute to PEDV virulence and vaccine attenuation.

Results

Isolation and Sequence Comparison of U.S. PEDVs

Three U.S. PEDV prototype isolates USA/NC35140/2013, USA/IA49379/2013 and USA/NC49469/2013 were isolated in Vero cells. Typical PEDV cytopathic effects including syncytial body formation and cell detachment were observed and virus growth was confirmed by immunofluorescence staining. All isolates grew efficiently in Vero cells and the infectious titers ranged from 103-106 TCID50/ml for the first ten passages.

The whole genome sequences of the three U.S. PEDV prototype isolates USA/NC35140/2013-P7, USA/IA49379/2013-P7, and USA/NC49469/2013-P7 were determined and compared to those of the previously described U.S. PEDV prototype isolate USA/IN19338/2013 and U.S. PEDV S-INDEL-variant isolate USA/IL20697/2014 with results summarized in Table 3. Schematic diagrams of PEDV genome organization and putative functions of viral proteins are described in FIG. 12. The prototype isolates USA/IN19338/2013-P7, USA/NC35140/2013-P7, USA/IA49379/2013-P7 and USA/NC49469/2013-P7 all had a genome of 28,038 nucleotides in length and had 99.75-99.91% nucleotide (nt) identity (26-69 nt differences) to each other at the whole genome level. The spike genes of these prototype isolates all had 4,161 nucleotides in length and had 99.54-99.88% nt identity (5-19 nt differences) to each other. The S-INDEL-variant isolate 2014020697-P7 had a genome of 28,029 nucleotides in length and had 99.08-99.22% nt identity (220-259 nt differences) at the whole genome level to the four prototype isolates evaluated in this study. Among them, about 64-96 nt differences were located in ORF1a/1b region especially the nsp12 and nsp16 regions; however, a majority of these nt changes on nsp12 and nsp16 were synonymous (silent) changes at the amino acid level (Table 3). Striking differences between the U.S. PEDV prototype and S-INDEL-variant isolates were located in the spike gene (96.25-96.37% nt identity; 151-156 nt differences) especially the S1 portion (93.14-93.32% nt identity; 148-152 nt differences); the nucleotide changes at the S1 portion resulted in changes of the deduced amino acids (Table 3). Compared to the prototype isolates, the S gene of the variant isolate 2014020697-P7 had three characteristic deletions (a 1-nt deletion of G at position 167, an 11-nt deletion of AGGGTGTCAAT at positions 176-186, and a 3-nt deletion of ATA at positions 416-418) and one insertion (a 6-nt insertion of CAGGAT between positions 474 and 475).

Figure 6C:
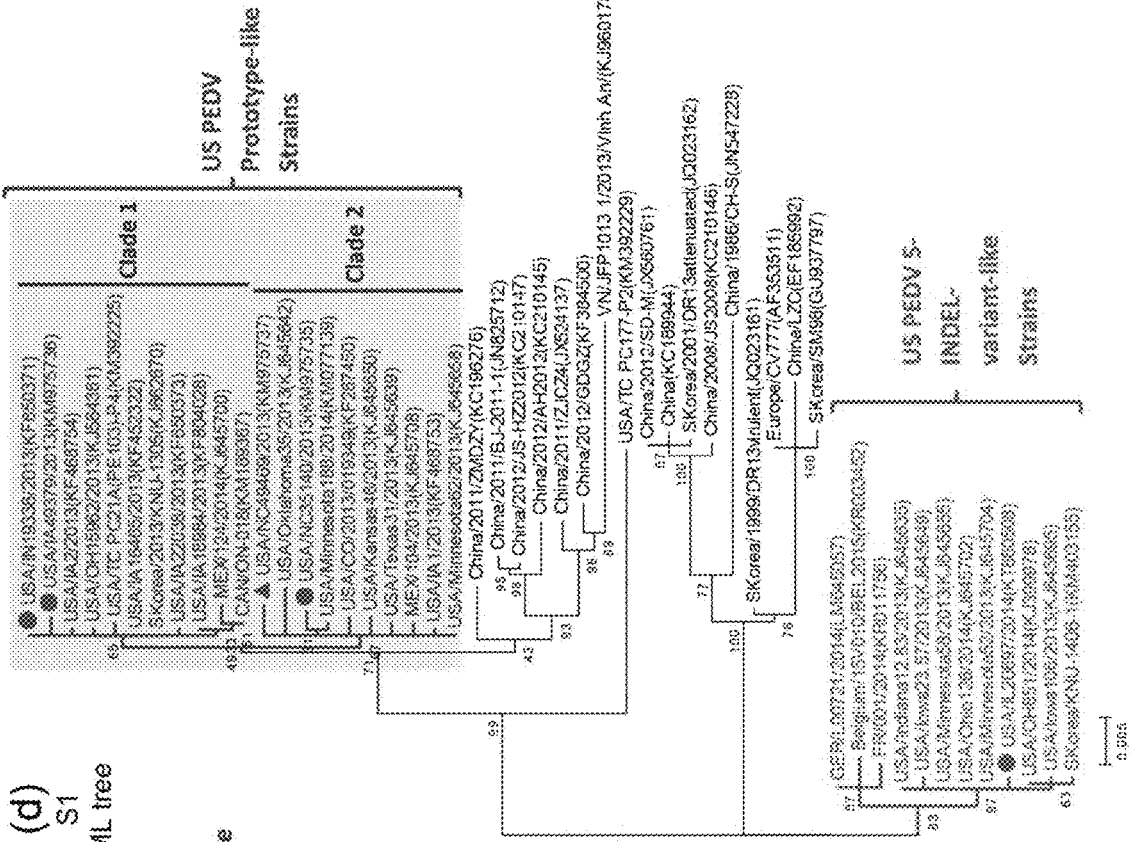
Figure 6D:
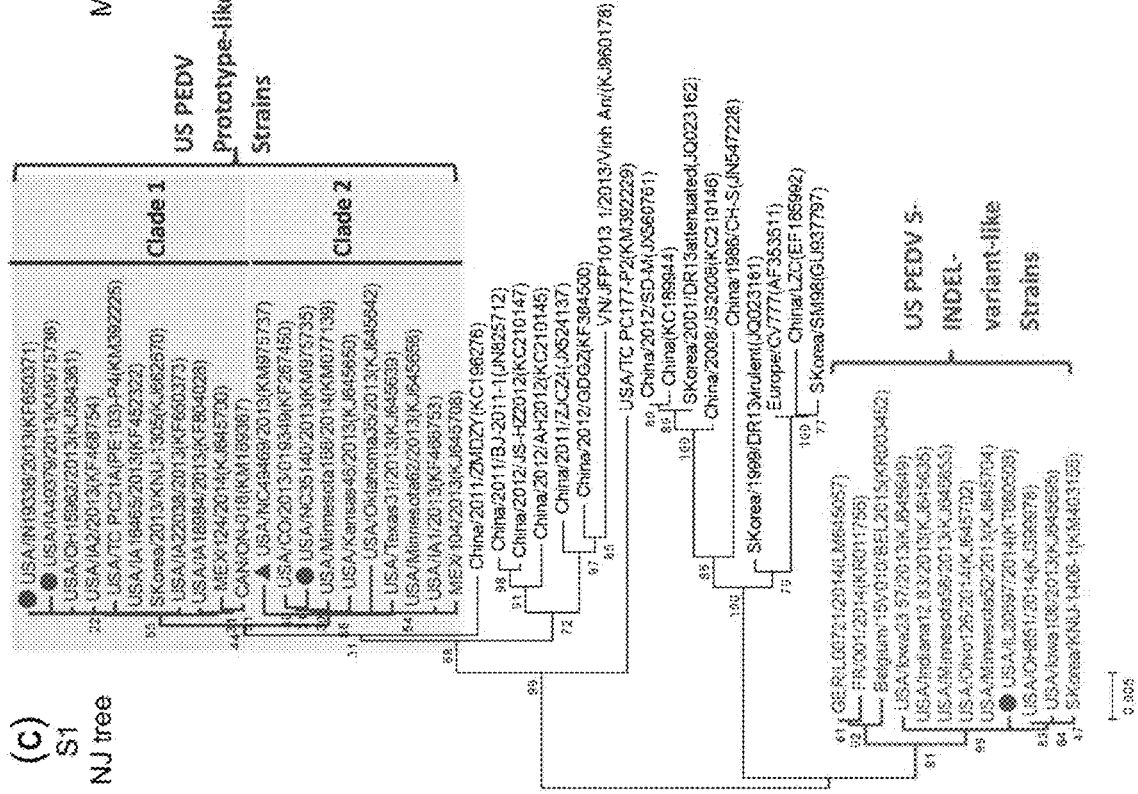

Phylogenetic analyses of the PEDV isolates described in this study and 45 PEDV reference sequences are provided in FIG. 6. In the whole genome sequence-based neighbor-joining tree FIG. 6A, the U.S. PEDV prototype-like strains clustered together, which can be further divided into clade 1 and clade 2; however, the U.S. PEDV S-INDEL-variant-like strains clustered separately. In the whole genome sequence-based maximum likelihood tree FIG. 6B, the U.S. PEDV prototype-like strains also clustered into clade 1 and clade 2; however, the S-INDEL-variant-like strains formed a separate sublineage within clade 2. In contrast, the phylogenetic clusters in the S1 sequence-based neighbor-joining tree FIG. 6C and the maximum likelihood tree FIG. 6D were similar. In both FIG. 6C and FIG. 6D, the U.S. PEDV prototype-like strains clustered together which can be further divided into clade 1 and clade 2, similar to the whole genome sequence-based neighbor-joining tree FIG. 6A; the U.S. PEDV S-INDEL-variant-like strains formed a separate branch that was more closely related to some classical PEDV isolates such as Europe/CV777, South Korea/SM98, and China/SD-M which have the same pattern of insertions and deletions in the S gene as the U.S. PEDV S-INDEL-variant-like strains.

The prototype isolates IN19338 and IA49379 belong to the clade 1 and the isolate NC35140 belongs to the clade 2 regardless of the whole genome-based trees FIG. 6A, 6B or the S1-based trees FIG. 6C, 6D. However, the prototype isolate NC49469 belongs to the clade 1 in the whole genome-based trees FIG. 6A, 6B but belongs to the clade 2 in the S1-based trees FIG. 6C, 6D. Three prototype isolates USA/IN19338/2013-P7 (SEQ ID NO:59), USA/NC35140/2013-P7 (SEQ ID NO:60), and USA/NC49469/2013-P7 (SEQ ID NO:61) and one S-INDEL-variant isolate 2014020697-P7 (SEQ ID NO:62) were selected to compare their pathogenesis in pigs (Table 4).

TABLE 3

Nucleotide and amino acid differences between the U.S. PEDV prototype and S-INDEL-variant isolates

| Genome region or ORF (nucleotide position)* | Protein(s) and region(s) (length in amino acids) | Nucleotide and amino acid differences among the Prototype isolates (IN19338, IA49379, NC49469, and NC35140) | | Nucleotide and amino acid differences between the Prototype isolates (IN19338, IA49379, NC49469, and NC35140) and the S-INDEL-variant isolate IL20697 | |
|---|---|---|---|---|---|
| | | No. of nt diff (%)[1] | No. of aa diff (%)[1] | No. of nt diff (%) | No. of aa diff (%) |
| Whole genome (1-28038) | N/A[‡] | 26-69 (0.09-0.25%) | N/A | 220-259 (0.78-0.92%) | N/A |
| 5' UTR (1-292) | | 0-2 (0-0.68%) | N/A | 0-2 (0-0.68%) | N/A |
| | Nonstructural proteins (nsp) | | | | |
| ORF1ab (293-20637) | 1ab polyprotein (6781) | 16-50 (0.08-0.25%) | 9-16 (0.13-0.23%) | 64-96 (0.31-0.47%) | 7-19 (0.10-0.28%) |
| | nsp1: Met1-Gly110 (110) | 0 (0%) | 0 (0%) | 0 (0%) | 0 (0%) |
| | nsp2: Asn111-Gly895 (785) | 5-13 (0.21-0.55%) | 3-5 (0.38-0.64%) | 4-17 (0.17-0.72%) | 1-6 (0.13-0.76%) |
| | nsp3: Gly896-Gly2516 (1621) | 5-22 (0.10-0.45%) | 3-9 (0.18-0.56%) | 6-24 (0.12-0.49%) | 1-10 (0.06-0.62%) |
| | nsp4: Ala2517-Gln2997 (481) | 0-1 (0-0.07%) | 0 (0%) | 1-2 (0.07-0.14%) | 0 (0%) |
| | nsp5: Ala2998-Gln3299 (302) | 0-2 (0-0.22%) | 0 (0%) | 0-1 (0-0.11%) | 0 (0%) |
| | nsp6: Ser3300-Gln3579 (280) | 0-2 (0-0.24%) | 0 (0%) | 0-1 (0-0.12%) | 0 (0%) |
| | nsp7: Ser3580-Gln3662 (83) | 0 (0%) | 0 (0%) | 1 (0.40%) | 0 (0%) |
| | nsp8: Ser3663-Gln3857 (195) | 0 (0%) | 0 (0%) | 0 (0%) | 0 (0%) |
| | nsp9: Asn3858-Gln3965 (108) | 0 (0%) | 0 (0%) | 0 (0%) | 0 (0%) |
| | nsp10: Ala3966-Gln4100 (135) | 0-1 (0-0.25%) | 0 (0%) | 0-1 (0-0.25%) | 0 (0%) |
| | nsp12: Ser4101-Gln5027 (927) | 0-6 (0-0.22%) | 0-1 (0-0.11%) | 23-27 (0.83-0.97%) | 0-1 (0-0.11%) |
| | nsp13: Ser5028-Gln5546 (519) | 1-2 (0.06-0.12%) | 0 (0%) | 2-3 (0.12-0.19%) | 0 (0%) |
| | nsp14: Asn5547-Gln6141 (595) | 0-3 (0-0.17%) | 0-1 (0-0.17%) | 1-2 (0.06-0.11%) | 0-1 (0-0.17%) |
| | nsp15: Gly6142-Gln6480 (339) | 0-2 (0-0.20%) | 0-2 (0-0.59%) | 8-9 (0.79-0.88%) | 1-2 (0.29-0.59%) |
| | nsp16: Ala6481-Lys6781 (301) | 0-1 (0-0.11%) | 0-1 (0-0.33%) | 12-13 (1.32-1.43%) | 1-2 (0.33-0.66%) |
| | Structural and accessory proteins | | | | |
| Spike (20634-24794) | S (1386) | 5-19 (0.12-0.46%) | 3-10 (0.22-0.72%) | 151-156 (3.63-3.75%) | 59-65 (4.26-4.69%) |
| Spike 1 (20634-22847) | S1 (738) | 4-13 (0.18-0.59%) | 3-7 (0.41-0.95%) | 148-152 (6.68-6.86%) | 58-61 (7.86-8.27%) |
| Spike 2 (22848-24794) | S2 (648) | 0-6 (0-0.31%) | 0-3 (0-0.46%) | 3-8 (0.15-0.41%) | 1-4 (0.15-0.62%) |
| ORF3 (24794-25468) | NS3B (224) | 0-3 (0-0.44%) | 0-1 (0-0.45%) | 1-3 (0.15-0.44%) | 0-1 (0-0.45%) |
| Envelope (25449-25679) | E (76) | 0-1 (0-0.43%) | 0-1 (0-1.31%) | 0-1 (0-0.43%) | 0-1 (0-1.31%) |
| Membrane (25687-26367) | M (226) | 0 (0%) | 0 (0%) | 0 (0%) | 0 (0%) |
| Nucleocapsid (26379-27704) | N (441) | 1-2 (0.07-0.15%) | 0-2 (0-0.45%) | 3-4 (0.23-0.30%) | 1-2 (0.23-0.45%) |
| 3' UTR (27705-28038) | N/A | 0 (0%) | N/A | 0 (0%) | N/A |

*Nucleotides are numbered according to the sequence of the U.S. PEDV prototype isolate USA/IN19338/2013 (GenBank accession number KF650371).
[1]Percentage of nucleotide (nt) and amino acid (aa) differences were calculated at each gene or protein level.
[‡]N/A: Not applicable.

TABLE 4

Experimental design of 5-day-old pigs inoculated with various PEDV isolates

| Group | Piglets | U.S. PEDV Strain | Inoculum | Necropsy (3 DPI) | Necropsy (7 DPI) |
|---|---|---|---|---|---|
| G1 | N = 10 | Prototype isolate USA/IN19338/2013-P7 | $10^4$ TCID$_{50}$/ml; 10 ml | N = 5 | N = 5 |
| G2 | N = 10 | Prototype isolate USA/NC35140/2013-P7 | $10^4$ TCID$_{50}$/ml; 10 ml | N = 5 | N = 5 |
| G3 | N = 10 | Prototype isolate USA/NC49469/2013-P7 | $10^4$ TCID$_{50}$/ml; 10 ml | N = 5 | N = 5 |
| G4 | N = 10 | S-INDEL-variant isolate USA/IL20697/2014-P7 | $10^4$ TCID$_{50}$/ml; 10 ml | N = 5 | N = 5 |
| G5 | N = 10 | Virus-negative culture medium | 10 ml | N = 5 | N = 5 |

Clinical Assessment

All pigs in G1 (USA/IN19338/2013-P7), G2 (USA/NC35140/2013-P7), and G3 (USA/NC49469/2013-P7) developed soft to watery diarrhea starting from 1 DPI and continuing through 6 or 7 DPI. In contrast, in G4 (IL20697), only 1 pig had mild diarrhea with soft feces at 1 DPI. The average diarrhea scores are summarized in FIG. 7A. Overall, pigs in G1 (P=0.001) and G3 (P<0.0001) had significantly higher average diarrhea scores than pigs in G2 when 0-7 DPI diarrhea scores were analyzed as described in the 'Materials and Methods' section below. Pigs in G1-G3 inoculated with the prototype PEDV isolates overall had significantly higher average diarrhea scores than G4 (P<0.0001) inoculated with the PEDV variant isolate and G5 (negative control, P<0.0001). The average diarrhea scores were not significantly different between G4 and G5 (P=1).

No vomiting was observed from any pigs throughout the study. In G1-G3 inoculated with the prototype isolates: 1) almost all pigs lost their appetite during the study period and tube feeding had to be administered; 2) severe dehydration, rough hair, flat or thin flanks were observed in all pigs with most severe body conditions at about 4 DPI; 3) various degrees of lethargy including head down and recumbence were observed from 1 DPI to the end of the study. In contrast, in G4 inoculated with the variant isolate: 1) all pigs had normal appetite; 2) no dehydration or lethargy was observed; 3) 90% pigs had mild flat flanks at 1 DPI or 2 DPI but recovered to normal after 4 DPI. All G5 pigs were active without diarrhea, dehydration, lethargy or anorexia during the study period.

Figure 7:
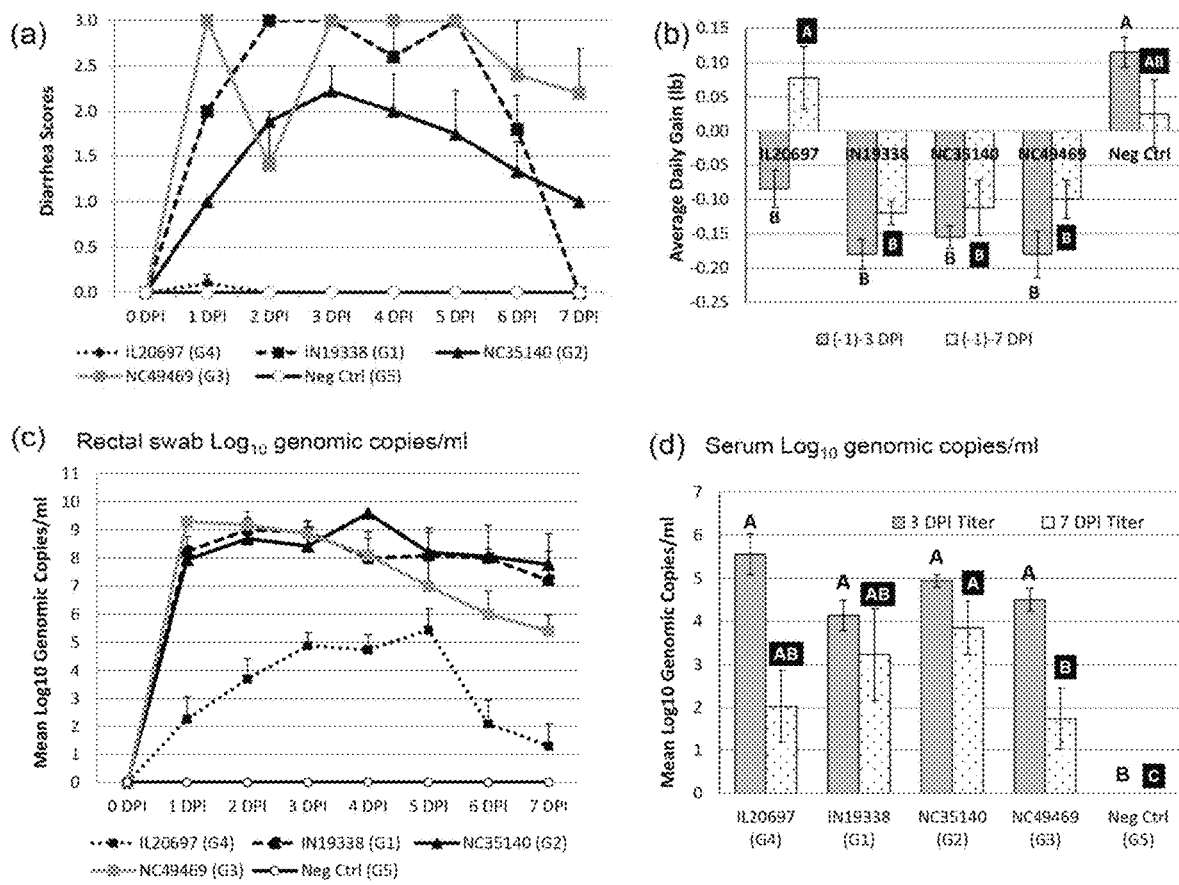
FIG. 7A-7D show the clinical assessment and virus shedding of 5-day-old pigs inoculated with U.S. PEDV prototype and S-INDEL-variant isolates.

From (−1) to 3 DPI, PEDV-inoculated pigs (G1-G4) had significantly lower average daily gain (ADG, P≤0.0001) compared to pigs in G5 (negative control), but there were no significant differences in ADG (P-values ranged from 0.089-1) among G1-G4 (FIG. 7B). From (−1) to 7 DPI, G1-G3 (prototype isolates) had significantly lower ADG (P-values ranged from 0.01-0.037) than G4 (variant isolate) although none of the G1, G2, G3, or G4 had significant difference in ADG (P-values ranged from 0.078-0.847) compared to G5 (negative control) (FIG. 7B).

Virus Shedding and Distribution

PEDV RNA was detected in rectal swab samples from all pigs in G1-G3 (prototype isolates) at 1 DPI until the end of the study. In G4 (variant isolate), PEDV RNA was detected in rectal swabs from 5/10, 8/10, 10/10, 5/5, 5/5, 3/5, and 2/5 pigs at 1, 2, 3, 4, 5, 6 and 7 DPI, respectively. The average genomic copies per ml of virus shed in rectal swabs are summarized in FIG. 7C. Pigs in G1 and G2 had similar levels (P=0.601) of fecal virus shedding from 1-7 DPI with the quantity ranging from 107.2-9.0 genomic copies/ml, corresponding to Ct values 16-22. Pigs in G3 had the highest level of fecal virus shedding at 1-2 DPI (approximately 109 genomic copies/ml with Ct 16) and the fecal virus shedding gradually declined to approximately 105.4 genomic copies/ml at 7 DPI, corresponding to Ct value 28. In contrast, pigs in G4 had about 102.3 genomic copies/ml (Ct 31.8) fecal virus shedding at 1 DPI; the fecal virus shedding gradually increased and peaked at 5 DPI (105.4 genomic copies/ml with Ct 28.8) and then declined to approximately 101.3 genomic copies/ml (Ct 36.3) at 7 DPI. Statistical analyses indicated that G1-G3 (prototype isolates) had significantly larger amounts of viral RNA shedding in rectal swabs (P<0.0001) compared to G4 (variant isolate).

PEDV RNA was detected in serum samples from all pigs in G1-G4 necropsied at 3 DPI with average Ct values of 33.2 (G1), 30.5 (G2), 31.9 (G3) and 28.4 (G4). There were no significant differences between average PEDV genomic copies in sera of G1-G4 at 3 DPI [P-values ranged from 0.077-0.646, FIG. 7D. At 7 DPI, PEDV RNA was detected in serum samples from 3-4 out of 5 pigs in G1-G4 with average Ct values (only on PCR-positive pigs) of 33.5 (G1), 34.2 (G2), 37.4 (G3) and 35.8 (G4). The average genomic copies of PEDV in sera of G4 (variant isolate) had no significant difference (P-values ranged from 0.050-0.717) compared to those in G1-G3 (prototype isolates) at 7 DPI FIG. 7D.

Virus distributions in tissues are summarized in Table 5. At 3 DPI, regardless of G1, G2, G3 or G4, average PEDV RNA concentrations in ileums, ceca, colons and mesenteric lymph nodes were higher than the concentrations in other tissues within the same inoculation group. When viral RNA concentrations in each tissue type were compared across four inoculation groups at 3 DPI, viral RNA concentrations in cecum and colon of G4 (variant isolate) were overall significantly lower than in cecum and colon of G1-G3 (prototype isolates); however, viral RNA concentrations in other tissues of G4 were similar to those in the corresponding tissues of G1-G3; the same types of tissues in G1-G3 had similar levels of viral RNA. Data at 7 DPI overall supported similar conclusions to 3 DPI except that viral genomic copies in cecum and colon were much lower than the genomic copies in ileum and mesenteric lymph node in G4.

All rectal swabs, sera, and tissue samples from G5 (negative control) were negative by PEDV real-time RT-PCR throughout the study period.

TABLE 5

PCR detection of PEDV RNA in various tissues at 3 DPI and 7 DPI from pigs inoculated with four PEDVs.

| | | IL20697 (Variant; G4) | | | IN19338 (Prototype; G1) | | | NC35140 (Prototype; G2) | | | NC49469 (Prototype; G3) | | |
|---|---|---|---|---|---|---|---|---|---|---|---|---|---|
| | Specimen | PCR positive | Mean Ct[+] | Genomic copies/ml[‡] | PCR positive | Mean Ct[+] | Genomic copies/ml[‡] | PCR positive | Mean Ct[+] | Genomic copies/ml[‡] | PCR positive | Mean Ct[+] | Genomic copies/ml[‡] |
| 3 DPI | Stomach | 5/5 | 31.9 | $3.25 \times 10^4$A | 5/5 | 23.9 | $7.45 \times 10^6$A | 4/5 | 25.9 | $1.07 \times 10^5$A | 5/5 | 27.9 | $5.06 \times 10^5$A |
| | Ileum | 5/5 | 17.1 | $7.49 \times 10^8$B | 5/5 | 16.5 | $1.17 \times 10^9$AB | 5/5 | 16.4 | $1.22 \times 10^9$AB | 5/5 | 15.8 | $1.88 \times 10^9$A |
| | Cecum | 5/5 | 22.5 | $2.01 \times 10^7$C | 5/5 | 20.5 | $7.81 \times 10^7$BC | 5/5 | 19.9 | $1.12 \times 10^8$B | 5/5 | 16.9 | $8.55 \times 10^8$A |
| | Colon | 5/5 | 25.0 | $3.58 \times 10^6$B | 5/5 | 15.7 | $1.90 \times 10^9$A | 5/5 | 16.8 | $9.44 \times 10^8$A | 5/5 | 14.3 | $5.02 \times 10^9$A |
| | Tonsil | 4/5 | 32.4 | $3.19 \times 10^3$A | 5/5 | 30.1 | $1.13 \times 10^5$A | 5/5 | 32.7 | $1.98 \times 10^4$A | 4/5 | 32.7 | $2.63 \times 10^3$A |
| | Heart | 5/5 | 34.6 | $5.33 \times 10^3$A | 4/5 | 35.7 | $5.28 \times 10^2$A | 4/5 | 35.4 | $6.30 \times 10^2$A | 4/5 | 36.4 | $3.53 \times 10^2$A |
| | Lung | 3/5 | 34.2 | $2.07 \times 10^2$A | 2/5 | 36.7 | $1.76 \times 10^1$A | 1/5 | 36.4 | $4.36 \times 10^0$A | 2/5 | 36.0 | $2.10 \times 10^1$A |
| | Liver | 5/5 | 32.0 | $3.14 \times 10^4$A | 4/5 | 33.4 | $1.83 \times 10^3$A | 3/5 | 33.3 | $2.91 \times 10^2$A | 4/5 | 34.2 | $1.16 \times 10^3$A |
| | Spleen | 5/5 | 32.1 | $2.93 \times 10^4$A | 5/5 | 33.8 | $9.44 \times 10^3$A | 4/5 | 33.3 | $1.89 \times 10^3$A | 5/5 | 34.9 | $4.37 \times 10^3$A |
| | Kidney | 3/5 | 34.4 | $1.84 \times 10^2$A | 3/5 | 34.3 | $1.99 \times 10^2$A | 3/5 | 36.9 | $6.70 \times 10^1$A | 1/5 | 35.9 | $4.65 \times 10^0$A |
| | MLN | 5/5 | 21.3 | $4.52 \times 10^7$AB | 5/5 | 19.3 | $1.76 \times 10^8$A | 5/5 | 22.9 | $1.46 \times 10^7$B | 5/5 | 21.1 | $5.21 \times 10^7$AB |
| | Muscle* | 5/5 | 33.9 | $8.77 \times 10^3$B | 5/5 | 30.8 | $7.26 \times 10^4$A | 5/5 | 33.5 | $1.09 \times 10^4$AB | 5/5 | 34.9 | $4.26 \times 10^3$B |
| 7 DPI | Stomach | 0/5 | >45 | 0B | 3/5 | 36.1 | $9.57 \times 10^1$A | 3/5 | 32.1 | $3.11 \times 10^1$AB | 1/5 | 36.7 | $4.16 \times 10^0$AB |
| | Ileum | 5/5 | 25.8 | $2.15 \times 10^6$B | 5/5 | 24.0 | $7.29 \times 10^6$AB | 5/5 | 21.6 | $3.54 \times 10^7$A | 5/5 | 24.4 | $5.36 \times 10^6$AB |
| | Cecum | 5/5 | 36.0 | $2.12 \times 10^3$B | 5/5 | 28.9 | $2.57 \times 10^5$A | 5/5 | 26.4 | $1.38 \times 10^6$A | 4/5 | 29.1 | $1.92 \times 10^4$AB |
| | Colon | 1/5 | 34.2 | $5.85 \times 10^0$B | 5/5 | 23.9 | $7.37 \times 10^6$AB | 5/5 | 22.1 | $2.58 \times 10^7$A | 4/5 | 26.6 | $7.23 \times 10^4$A |
| | Tonsil | 4/5 | 36.2 | $3.99 \times 10^2$A | 5/5 | 32.6 | $2.13 \times 10^4$A | 4/5 | 35.5 | $2.99 \times 10^3$A | 3/5 | 34.5 | $1.79 \times 10^2$A |
| | Heart | 0/5 | >45 | 0A | 2/5 | 36.1 | $2.08 \times 10^1$A | 3/5 | 36.5 | $1.14 \times 10^1$A | 0/5 | >45 | 0A |
| | Lung | 0/5 | >45 | 0A | 1/5 | 34.6 | $5.58 \times 10^0$A | 3/5 | 32.0 | $3.17 \times 10^1$A | 0/5 | >45 | 0A |
| | Liver | 0/5 | >45 | 0A | 1/5 | 32.4 | $7.46 \times 10^0$A | 2/5 | 37.5 | $5.24 \times 10^0$A | 0/5 | >45 | 0A |
| | Spleen | 2/5 | 36.5 | $1.87 \times 10^1$A | 3/5 | 35.8 | $1.04 \times 10^2$A | 3/5 | 34.0 | $2.02 \times 10^1$A | 1/5 | 38.2 | $3.43 \times 10^0$A |
| | Kidney | 0/5 | >45 | 0A | 1/5 | 38.1 | $3.47 \times 10^0$A | 3/5 | 35.4 | $1.47 \times 10^1$A | 0/5 | >45 | 0A |
| | MLN | 5/5 | 26.2 | $1.57 \times 10^6$A | 5/5 | 26.3 | $1.50 \times 10^6$A | 5/5 | 24.9 | $3.74 \times 10^6$A | 5/5 | 27.3 | $7.63 \times 10^5$A |
| | Muscle* | 0/5 | >45 | 0B | 3/5 | 35.5 | $1.20 \times 10^2$AB | 3/5 | 30.9 | $2.54 \times 10^2$A | 0/5 | >45 | 0B |

Abbreviations: DPI, days post inoculation; MLN, mesenteric lymph node; PCR polymerase chain reaction; Ct, cycle threshold.
*Rear leg muscle.
[+]Mean Ct was mean Ct value of PCR-positive pigs (pigs with PCR Ct < 45).
[‡]Genomic copies/ml was geometric mean of genomic copies per milliter of all pigs (both PCR-positive and negative pigs). Staistical analyses were performed on the same tissue types for G1-G4 groups and different letters indicate significant differences.

Gross Pathology

At 3 DPI, thin and transparent walls, sometimes dilated by gas and/or yellowish fluid, were observed in small intestine, cecum and colon tissues in most pigs inoculated with the PEDV prototype isolates (G1-G3). In addition, almost all pigs in G1-G3 contained watery contents in small intestines, ceca and colons. In contrast, only mildly thin walls could be observed in small intestines of 3/5 pigs inoculated with the PEDV variant isolate (G4); no apparent gross lesions were observed in ceca or colons of pigs in G4. Also, in G4, only 1/5 pigs had watery contents in small intestine, cecum and colon; two other pigs had semi-watery contents in cecum. Statistically, all G1-G3 (prototype isolates) had significantly higher small intestine, cecum and colon content scores (P-values ranged from <0.0001 to 0.0127) than G4 (variant isolate) and G5 (negative control) FIG. 8A. A significant difference was not observed among G1-G3 (P-values ranged from 0.3722-1) for small intestine, cecum, and colon content scores FIG. 8A. For G4, only cecum content scores were significantly higher than G5 (P=0.003), but not small intestine or colon content scores [P-values ranged from 0.5259-1; FIG. 8A]. All prototype isolate-inoculated groups (G1-G3) had significantly higher tissue lesion scores on small intestine, cecum, and colon (P-values ranged from 0.0012-0.049) than the variant isolate-inoculated group (G4) and the negative control group (G5) FIG. 8B. No significant differences were observed on small intestine, cecum and colon lesion scores among G1-G3 (P-values ranged from 0.1585-1) or between G4 and G5 [P-values ranged from 0.4766-1; FIG. 8B].

At 7 DPI, most pigs in G1-G3 still had thin-walled and/or gas-distended small intestines but only about 50% of pigs in G1-G3 had thin-walled and/or gas-distended ceca and colons. All pigs in G1 and G2 and 4/5 pigs in G3 had watery small intestine contents. About 60-100% of pigs in G1-G3 had semi-watery or watery contents in ceca and colons. In G4, only 1/5 pig had thin-walled small intestines and none of the pigs had gross lesions in ceca and colons. In G4, 5/5, 1/5 and 0/5 pigs had semi-watery or watery contents in small intestines, ceca, and colons, respectively. In G5, 1/5 pigs had thin-walled small intestine, cecum and colon; 3/5 pigs had semi-watery or watery contents in small intestines, ceca and colons. Significant differences on tissue content scores and tissue lesion scores were observed between some groups (FIG. 8).

Rectal swabs collected at 3 DPI and 7 DPI were confirmed negative for PDCoV, TGEV, and porcine rotaviruses (groups A, B &C) and negative for hemolytic E. coli and Salmonella spp.

Histopathology

No remarkable microscopic lesions were observed in stomach, cecum, colon, tonsil, mesenteric lymph node, heart, lung, liver, spleen, and kidney sections of all piglets (G1-G5) at either 3 DPI or 7 DPI.

Severe lesions consistent with viral enteritis (e.g. villous enterocyte swelling, villous atrophy, collapsed lamina propria etc.) were observed in small intestinal sections (duodenum, jejunum, and ileum) of all pigs in G1-G3 (prototype isolates) necropsied at 3 DPI and 7 DPI. Mild microscopic lesions consistent with viral enteritis were observed in small intestinal sections of pigs in G4 (variant isolate) necropsied at 3 DPI; however, microscopic lesions were not remarkable in small intestinal sections of pigs in G4 necropsied at 7 DPI. Microscopic lesions were not apparent in small intestinal sections of pigs in G5 (negative control) at either 3 DPI or 7 DPI. Representative images of H&E-stained ileum sections of pigs necropsied at 3 DPI from G1-G5 are shown in FIG. 9A-9E.

Figure 10:
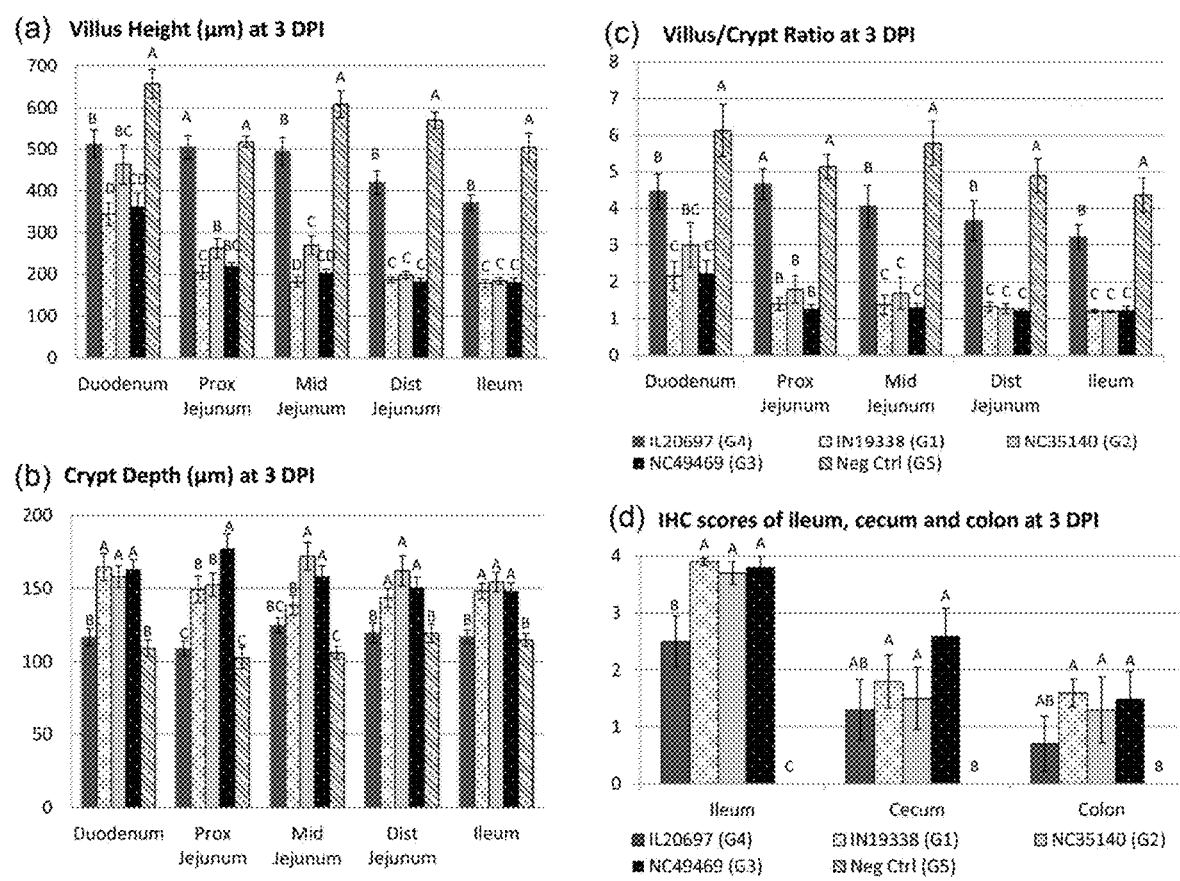

Villus height, crypt depth, and villus-height-to-crypt-depth ratio were measured and compared on small intestinal sections of 5 inoculation groups. At 3 DPI, pigs in G1-G3 (prototype isolates) had significantly decreased average villus heights, increased average crypt depths, and lower average villus/crypt ratios in duodenum, proximal jejunum, middle jejunum, distal jejunum, and ileum than pigs in G4 (variant isolate) and G5 (negative control) with some exceptions (FIG. 10); exceptions include villus height and villus/crypt ratio in duodenum of G2 and G4 as well as crypt depth in middle jejunum of G1 and G4. The average villus heights, crypt depths, and villus/crypt ratios of small intestine sections at 3 DPI were overall similar across the three groups G1-G3 inoculated with the prototype isolates (FIG. 10). The average crypt depths of all small intestinal sections at 3 DPI were not significantly different between G4 (variant isolate) and G5 (negative control); however, pigs in G4 had significantly decreased average villus heights and lower average villus/crypt ratios in duodenum, middle and distal jejunum and ileum at 3 DPI compared to pigs in G5 (FIG. 10).

At 7 DPI, the average villus heights and villus/crypt ratios of small intestinal sections were overall similar across the three groups G1-G3 FIG. 11A-11D. Pigs in G1-G3 overall had significantly decreased average villus heights and lower average villus/crypt ratios in small intestinal sections than pigs in G4 and G5 at 7 DPI (FIG. 11A, 11C). Interestingly, the average villus heights at 7 DPI were either not significantly different between G4 (variant isolate) and G5 (negative control) or were significantly higher in G4 than G5 (FIG. 11A). The average villus/crypt ratios at 7 DPI were not significantly different in proximal, middle and distal jejunum, and ileum between G4 and G5 although the average villus/crypt ratios in duodenum were significantly different between G4 and G5 (FIG. 10C). Comparison of average crypt depths at 7 DPI is presented in FIG. 11B. The average crypt depths were similar in all small intestinal sections between the prototype isolate-inoculated groups G2 and G3; both G2 and G3 had significantly longer crypt depths compared to the negative control group G5. Another prototype-isolate inoculated group G1 had the average crypt depth values that were between the negative control group G5 and the prototype isolate-inoculated groups G2 and G3. The variant isolate-inoculated group G4 had significantly increased average crypt depths in duodenum, proximal and distal jejunums compared to the negative control group G5, while G4 had similar average crypt depths to G1, G2, and G3 in most of the small intestinal sections.

Immunohistochemistry (IHC)

Figure 9:
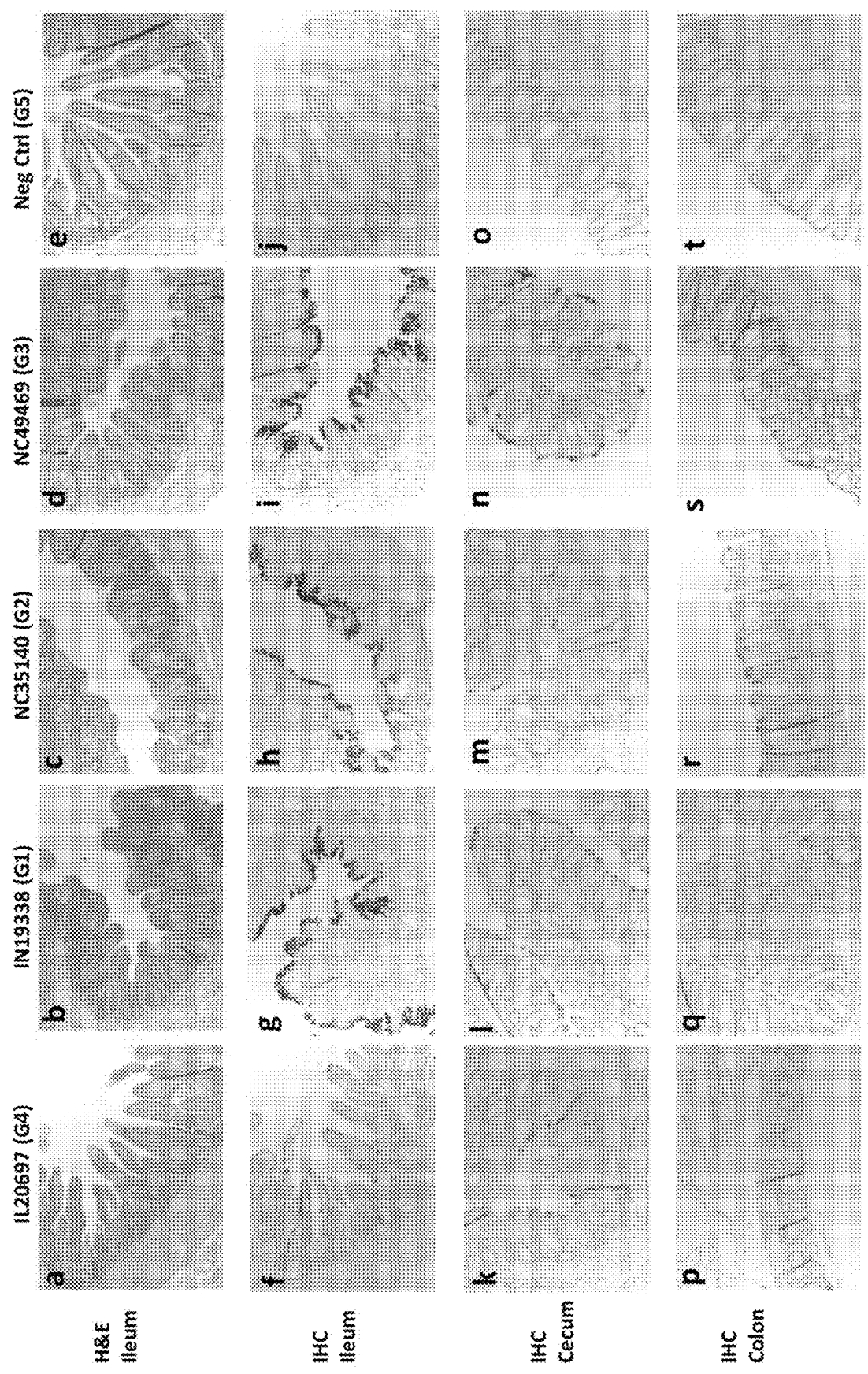
FIG. 9A-9T show representative microscopic lesions and IHC staining of inoculated pigs necropsied at 3 DPI. Hematoxylin and eosin-stained tissue sections of small intestine (ileum) from different inoculation group (FIG. 9A-9E).

At 3 DPI, PEDV-specific IHC staining was performed on serial sections of ileum, cecum and colon of all 5 inoculation groups. None of the 5 pigs in G5 (negative control) were IHC positive in the ileum, cecum or colon. All 5 pigs in each of G1-G4 were IHC positive in the ileum with average IHC scores of 3.9 (G1), 3.7 (G2), 3.8 (G3) and 2.5 (G4). The average IHC scores for ileum were similar across G1-G3 but were significantly higher than G4 (FIG. 10D). Regarding IHC staining of ceca, 5/5 (G1), 4/5 (G2), 5/5 (G3), and 3/5 (G4) pigs were positive, with no significant differences on average IHC scores among G1-G4 (FIG. 10D). For colons, 5/5 (G1), 4/5 (G2), 4/5 (G3) and 2/5 (G4) pigs were IHC staining positive but the average IHC scores were not significantly different among G1-G4 (FIG. 10D). Representative PEDV IHC staining images are shown in FIG. 9F-9T.

At 7 DPI, PEDV IHC staining was only performed on serial sections of ileum. Mild/scant IHC staining was observed in G1 and G2 but no staining was observed in G3, G4 and G5 (FIG. 11D).

DISCUSSION

Sequence analyses demonstrated that at least two genetically different PEDV strains have been circulating in the U.S. (Vlasova et al., 2014; Wang et al., 2014), and they are referred as U.S. PEDV prototype strain and U.S. PEDV S-INDEL-variant strain. The U.S. prototype PEDVs can be phylogenetically further divided into clade 1 and clade 2. In the whole genome sequence-based phylogenetic analyses, the U.S. S-INDEL-variant-like PEDVs clustered separately from the clade 1 and clade 2 in the neighbor-joining tree but they formed a separate sublineage within clade 2 in the maximum likelihood tree (FIG. 6A, 6B). This suggests that phylogenetic analysis tools and tree construction methods could result in some differences in the outcomes of the analyses; thus, conclusions should be drawn cautiously by clearly indicating the tools and methods used for phylogenetic analyses. Among U.S. prototype PEDVs, some always belong to clade 1 or clade 2 regardless of whole genome-based trees or S1-based trees; however, some (e.g. NC49469 and Minnesota62) belong to clade 1 in whole genome-based trees but belong to clade 2 in S1-based trees (FIG. 6). It is probably because the S1 sequences of NC49469 and Minnesota62 PEDVs are more closely related to clade 2 but the remaining genome sequences are more closely related to clade 1 PEDVs. Our group has isolated various PEDVs in cell culture that fall into each category described above, enabling us to compare the pathogenesis of various U.S. prototype and S-INDEL-variant PEDVs.

Studies have demonstrated that neonatal piglets are more susceptible than weaned pigs to PEDV infection and PEDV infection induces greater disease severity in neonates than in weaned pigs (Jung et al., 2015a; Thomas et al., 2015). Therefore, a sensitive 5-day-old neonatal piglet model was selected for pathogenesis comparisons in this study. Among three U.S. PEDV prototype isolates (USA/IN19338/2013, USA/NC35140/2013, and USA/NC49469/2013), the average diarrhea scores induced by the USA/NC35140/2013-P7 isolate were lower than those by the USA/IN19338/2013-P7 and USA/NC49469/2013-P7 isolates; however, three prototype isolates had similar virus shedding, gross lesions, histopathological lesions, and IHC staining. Overall, we conclude that three U.S. PEDV prototype isolates evaluated in this study have similar pathogenicity in neonatal piglets regardless of their phylogenetic clades. In contrast, data in the current study clearly demonstrate that the U.S. PEDV S-INDEL-variant isolate 2014020697-P7 had significantly diminished clinical signs, virus shedding in feces, gross lesions in small intestines, ceca and colons, histopathological lesions in small intestines, and IHC scores in ileum, compared to three U.S. PEDV prototype isolates USA/IN19338/2013-P7, USA/NC35140/2013-P7 and USA/NC49469/2013-P7. Recent experimental studies by other groups also demonstrated that S-INDEL PEDVs overall had lower pathogenicity compared to the U.S. prototype strains in 3-4 day old pigs or 1-week-old pigs (Lin et al., 2015a; Yamamoto et al., 2015). However, in Lin et al study, they observed that three litters of piglets inoculated with a U.S. S-INDEL Iowa106 strain had zero mortality but one litter of piglets inoculated with the same virus strain had 75% mortality (Lin et al., 2015a). They hypothesize that the sows' health condition can have a direct impact on colostrum/milk production and thus affect the infection outcome of their piglets (Lin et al., 2015a). The virulence of S-INDEL PEDVs observed in the field has variations among farms and countries. In the U.S., the S-INDEL variant strain OH851 infection only caused minimal to no clinical signs in suckling piglets on the farm (Wang et al., 2014). In Germany, two sow farms were infected with an S-INDEL PEDV that has 99.4% nucleotide identity to the U.S. S-INDEL variant OH851 at the whole genome level; however, severity of clinical signs and mortality in suckling piglets varied significantly between the two farms (Stadler et al., 2015). Factors contributing to the contradictory findings have not been clearly identified. But source of viruses (wild type or cell-culture adapted viruses), inoculation/infection doses, animal/environmental conditions, and nucleotide/amino acid variations among S-INDEL PEDVs could contribute to the observed discrepancies among various experimental studies and field outbreaks. In addition, PEDV pathogenicity can be age-dependent. Further investigations of pathogenicity of S-INDEL PEDV variants in weaned pigs, finisher pigs, gilts and sows are warranted.

Studies have shown that viremia can occur in the acute stage of infection with U.S. PEDV prototype isolates (Jung et al., 2014; Madson et al., 2016). In the present study, we also detected PEDV RNA in serum samples. In addition, the PEDV variant isolate and three prototype isolates had similar viremia levels under the conditions of this study. PEDV is an enteropathogenic coronavirus that infects the villous enterocytes, resulting in villous atrophy and malabsorptive diarrhea. Some quantities of PEDV could be taken into the blood stream through mechanisms not-fully-understood. But PEDV is not believed to actively replicate in blood and viremia levels may not necessarily correlate to virulence/pathogenicity. In the current study, high levels of PEDV RNA were detected in small intestine, cecum, colon and mesenteric lymph nodes while low levels of PEDV RNA were detected in non-enteric tissues (tonsil, heart, lung, liver, spleen, kidney, and muscle) from pigs inoculated with either prototype or S-INDEL-variant PEDV. Previous studies indicated that PEDV viral antigen (U.S. prototype isolates) could be detected in small intestine, mesenteric lymph node, and some colon and spleen tissues (Jung et al., 2015b; Jung et al., 2014; Madson et al., 2016) but other non-enteric tissues such as lung, heart, kidney and liver were all negative for PEDV antigen (Madson et al., 2016). Therefore, detection of PEDV RNA does not necessarily mean that PEDV replicates in all of these non-enteric tissues. Considering that the blood was not drained before collecting each organ, the possibility that virus in these tissues was from blood cannot be excluded.

In the current study, PEDV IHC staining was only performed on ileum, cecum and colon of inoculated pigs. Among four groups inoculated with PEDVs (three prototype isolates and one variant isolate), PEDV IHC staining was observed in 100% ileums, 60-100% ceca, and 40-100% colons at 3 DPI. The average IHC scores in ileums were significantly lower in the variant isolate-inoculated pigs than in the prototype isolates-inoculated pigs, consistent with observations on gross pathology and histopathological lesions of small intestines. Although the average IHC scores in ceca and colons were numerically lower in pigs inoculated with the variant isolate than in pigs inoculated with three prototype isolates, the differences were not significant. However, PEDV variant isolate-inoculated pigs had fewer gross changes in cecum and colon than the prototype isolate-inoculated pigs. Thus, it may need to be further elucidated about the correlations of cecal and colonic changes to PEDV virulence/pathogenicity.

All four groups G1-G4 inoculated with PEDVs (three prototype isolates and one variant isolate) had significantly shortened villus heights compared to the negative control group G5 at 3 DPI and G1-G3 (prototype isolates) had significantly shortened villus heights compared to G4 (variant isolate). These indicate that both U.S. prototype and variant PEDV isolates can infect and destroy villus epithelium of small intestines, but the U.S. PEDV variant isolate caused less severe villous atrophy than prototype isolates. Intestinal crypt epithelial cells serve to replace the destroyed villous enterocytes. At 3 DPI, the average crypt depths of G4 (variant isolate) were not significantly different from G5 (negative control) but the average crypt depths of G1-G3 (prototype isolates) were significantly longer than G4 and G5. These may suggest that mild villous atrophy caused by U.S. PEDV variant isolate has not triggered significant proliferation and elongation of intestinal crypt at 3 DPI; however, intestinal crypts have started to elongate to some degree to repair severe villous atrophy in prototype isolate-inoculated groups G1-G3. At 7 DPI, prototype isolate-inoculated groups had longer average crypt depth than the negative control group, suggesting that crypt elongation continued to replace the damaged villus enterocytes but the villus epithelium has not recovered back to normal. The average crypt depths of some G4 (variant isolate) sections of small intestine were significantly longer than G5 (negative control) at 7 DPI, suggesting that elongation of crypts occurred later in G4 compared to the prototype isolate-inoculated groups G1-G3. The proliferated crypts eventually recovered the destroyed villus enterocytes apparent at 3 DPI in G4. IHC staining also supported these observations.

Studies have shown that the antibodies against U.S. PEDV prototype and S-INDEL-variant strains can cross-react and cross-neutralize both strains in vitro (Chen et al., 2016; Lin et al., 2015b). An in vivo study (Goede et al., 2015) showed that sows exposed to S-INDEL-variant PEDV infection 7 months ago could provide partial protection to newborn piglets challenged with a U.S. PEDV prototype strain. Another in vivo study (Lin et al., 2015a) demonstrated that 3-4 days old piglets exposed to S-INDEL-variant PEDV could partially protect against subsequent challenge with a U.S. prototype PEDV. Applicants also have data that demonstrates both U.S. PEDV prototype and S-INDEL-variant strains can provide homologous and heterologous protection against two virus strains in a weaned pig model. In the current study, it was demonstrated that U.S. PEDV S-INDEL-variant strain is less virulent than U.S. PEDV prototype strains in neonatal pigs. These data collectively suggest that U.S PEDV S-INDEL-variant strain could potentially be a modified live virus vaccine candidate against PED although additional evaluation work is needed to determine overall efficacy (see Examples 5 and 6 for additional work).

The striking sequence differences between U.S. prototype and S-NDEL-variant PEDVs are located in the spike gene especially the S1 portion. The sequence differences in the spike gene may be partially responsible for the virulence differences between U.S. prototype and S-INDEL-variant PEDVs.

Materials and Methods

Virus Isolates and Cells

Isolation and characterization of the U.S. PEDV prototype isolate USA/IN19338/2013 and S-INDEL-variant isolate USA/IL20697/2014 have been described (Chen et al., 2014; Chen et al., 2016). Three additional U.S. PEDV prototype isolates USA/NC35140/2013, USA/IA49379/2013 and USA/NC49469/2013 were obtained for this study, all from archived piglet feces submitted to the Iowa State University Veterinary Diagnostic Laboratory (ISU VDL) for routine diagnosis, following previously described virus isolation procedures (Chen et al., 2014). All PEDV isolation, propagation and titration were performed in Vero cells (ATCC CCL-81) as described (Chen et al., 2014). All PEDV isolates used in this study were confirmed negative for porcine deltacoronavirus (PDCoV), transmissible gastroenteritis virus (TGEV), and porcine rotaviruses (groups A, B, & C), porcine reproductive and respiratory syndrome virus, and porcine circovirus.

Virus Sequencing, Comparative Sequence Analysis and Phylogenetic Analysis

The whole genome sequences of the PEDV isolates described in this study were determined by next generation sequencing technology using Illumina MiSeq platform and assembled with SeqMan Pro version 11.2.1 (DNAstar Inc, Madison, Wis.) as described previously (Chen et al., 2014). The sequence data of these PEDV isolates were deposited to GenBank with the following accession numbers: USA/IN19338/2013 [KF650371], USA/NC35140/2013-P7 [KM975735], USA/IA49379/2013 [KM975736], USA/NC49469/2013-P7 [KM975737], and 2014020697-P7 [KT860508].

The whole genome sequences and individual gene sequences (nucleotide and amino acid sequences) of all PEDV isolates used in this study were aligned using ClustalX version 2.0 (Larkin et al., 2007) and BioEdit version 7.0.4.1 (Hall, 1999) to compare the genetic similarity. Phylogenetic analysis was conducted using the entire genome and the S1 portion (S gene nucleotides 1 to 2205 according to the sequence KF650371) nucleotide sequences of the PEDV isolates described in this study as well as representative global PEDVs (in total 50 sequences). Phylogenetic trees, respectively, were constructed using the distance-based neighbor-joining method and maximum likelihood method of MEGA version 6 (Tamura et al., 2013). Bootstrap analysis was carried out on 1,000 replicate dataset.

Experimental Design

The animal study protocol was approved by the Iowa State University Institutional Animal Care and Use Committee (Approval No. 6-14-7821-S; approved on 10th of July 2014). Fifty 5-day-old piglets were purchased from a conventional breeding farm and delivered to the Iowa State University Laboratory Animal Resources facilities. All pigs were intramuscularly injected with a dose of Excede® (Zoetis, Florham Park, N.J., USA) upon arrival and confirmed negative for PEDV, PDCoV, TGEV, and porcine rotaviruses (groups A, B, & C) by virus-specific PCRs on rectal swabs and negative for PEDV antibody by a virus-specific indirect fluorescent antibody (IFA) assay on serum samples at the ISU VDL. Pigs were blocked by weight and then randomly divided into 5 groups of 10 pigs each, one group per room on a solid floor. Pigs were fed a mixture of Esbilac (Hampshire, Ill.) liquid milk replacer and yogurt and had free access to water. After 1-day acclimation (piglets were 6 days old), pigs in groups 1 through 5 (G1-G5) were orogastrically inoculated with three U.S. PEDV prototype isolates USA/IN19338/2013-P7 (G1), USA/NC35140/2013-P7 (G2), USA/NC49469/2013-P7 (G3), one U.S. S-INDEL-variant isolate 2014020697-P7 (G4), or virus-negative culture medium (G5), respectively (10 ml/pig; all viruses were at the 7th passage in cell culture with the titer of $10^4$ TCID50/ml) (Table 4).

Piglets were evaluated daily for presence of vomiting and clinical signs of diarrhea, lethargy, and body condition. Diarrhea severity was scored with the following criteria: 0=normal, 1=soft (cowpie), 2=liquid with some solid content, 3=watery with no solid content. Lethargy levels were categorized as normal, mild lethargy (slow to move, head down), moderate lethargy (stands but wants to lie down), or severe lethargy (recumbent, moribund). Body condition was categorized as: normal, mild loss (flat flank), moderate (flank tucked in), or severe (backbone/ribs prominent).

Body weights were recorded prior to inoculation and then at 3 and 7 days post inoculation (DPI). The average daily gain (ADG) was calculated on pigs from (−1) to 3 DPI and (−1) to 7 DPI. Serum samples were collected at 0, 3, and 7 DPI. Rectal swabs were collected daily from each pig from 0 DPI to necropsy and were submerged into 1 ml PBS immediately after collection. Five pigs from each group were randomly selected for necropsy at 3 DPI, and the remaining pigs were necropsied at 7 DPI. Fresh and formalin-fixed samples collected at necropsy included: tonsil, heart, lung, liver, spleen, kidney, skeletal muscle from rear leg, stomach, mesenteric lymph node, duodenum, proximal jejunum, middle jejunum, distal jejunum, ileum, cecum, and colon. Collection of different intestinal segments was performed as previously described (Madson et al., 2014).

At necropsy, the small intestine, cecum and colon were examined for gross lesions by veterinary pathologists blind to the treatment groups. Tissue lesions were categorized as normal, thin-walled, and/or gas-distended. The presence of thin-walled intestines or gas-distended organs was numerated as 1 point, respectively; the presence of both thin-walled and gas-distended was numerated as 2 points. Contents of small intestine, cecum and colon were examined and scored with the criteria: 0=Normal, 1=liquid with some solids (semi-watery), 2=watery.

To rule out the possibility of concurrent infections with other pathogens, rectal swabs collected at 3 DPI and 7 DPI before necropsy were tested for PDCoV, TGEV, and porcine rotaviruses (groups A, B &C) by virus-specific PCRs and for hemolytic *E. coli* and *Salmonella* spp. by routine bacterial cultures at ISU VDL.

Virus Shedding as Examined by a Quantitative PEDV N Gene-Based Real-Time RT-PCR

Viral RNA was extracted from rectal swabs, serum, and 10% tissue homogenates as previously described (Chen et al., 2014). Five μl of each RNA template was used in PCR setup in a 25 μl total reaction using Path-ID™ Multiplex One-Step RT-PCR Kit (Thermo Fisher Scientific). The primers, probes and in vitro transcribed RNA used to generate standard curves of a quantitative PEDV N gene-based real-time RT-PCR had been described (Lowe et al., 2014; Madson et al., 2014; Thomas et al., 2015). Based on standard curves, virus concentration in the unit of genomic copies/ml in tested samples was calculated. The mean cycle threshold (Ct) values were calculated based on PCR positive samples, and the mean virus concentrations were calculated based on all pigs within the group (both PCR positive and negative pigs).

Histopathology

Tonsil, heart, lung, liver, spleen, kidney, mesenteric lymph node, stomach, duodenum, proximal jejunum, middle jejunum, distal jejunum, ileum, cecum, and colon tissues were fixed in 10% formalin, embedded, sectioned, and stained with hematoxylin and eosin (H&E) and examined by a veterinary pathologist blinded to individual animal identifications and treatment groups. Villus lengths and crypt depths were measured from three representative villi and crypts of duodenum, proximal jejunum, middle jejunum, distal jejunum, and ileum, using a computerized image system following previously described procedures (Madson et al., 2014). Villus-height-to-crypt-depth (villus/crypt) ratio of each tissue was calculated as the quotient of the average villus length divided by the average crypt depth.

Immunohistochemistry

Serial sections of ileum, cecum and colon at 3 DPI necropsy were evaluated for PEDV antigen by immunohistochemistry (IHC) using a PEDV-specific monoclonal antibody (BioNote, Hwaseong-si, Gyeonggi-do, Korea) as previously described (Madson et al., 2014). At 7 DPI necropsy, IHC staining was only performed on serial sections of ileum. The IHC antigen detection was semi-quantitatively scored as previously described (Chen et al., 2015) with the following criteria: 0=no staining; 1=approximately 1-10% enterocytes with positive staining; 2=approximately 10%-25% enterocytes with positive staining; 3=approximately 25%-50% enterocytes with positive staining; 4=approximately 50%-100% enterocytes with positive staining.

Statistical Analyses

Generalized linear mixed (GLIMMIX) model was used for all statistical comparisons with Statistical Analysis System (SAS) version 9.3 (SAS institute, Cary, N.C.). P-value<0.05 was defined as statistically significant. P-values of overall fecal viral shedding level [Log 10(genomic copies/ml)] were assessed among treatments from 0-7 DPI, with DPI and treatment as interacting variables, and similarly for analysis of diarrhea scores.

REFERENCES

Boniotti, M. B., Papetti, A., Lavazza, A., Alborali, G., Sozzi, E., Chiapponi, C., Faccini, S., Bonilauri, P., Cordioli, P. & Marthaler, D. (2016). Porcine Epidemic Diarrhea Virus and Discovery of a Recombinant Swine Enteric Coronavirus, Italy. Emerg Infect Dis 22, 83-87.

Chen, Q., Gauger, P., Stafne, M., Thomas, J., Arruda, P., Burrough, E., Madson, D., Brodie, J., Magstadt, D., Derscheid, R., Welch, M. & Zhang, J. (2015). Pathogenicity and pathogenesis of a United States porcine deltacoronavirus cell culture isolate in 5-day-old neonatal piglets. Virology 482, 51-59.

Chen, Q., Li, G., Stasko, J., Thomas, J. T., Stensland, W. R., Pillatzki, A. E., Gauger, P. C., Schwartz, K. J., Madson, D., Yoon, K. J., Stevenson, G. W., Burrough, E. R., Harmon, K. M., Main, R. G. & Zhang, J. (2014). Isolation and characterization of porcine epidemic diarrhea viruses associated with the 2013 disease outbreak among swine in the United States. J Clin Microbiol 52, 234-243.

Chen, Q., Thomas, J. T., Giménez-Lirola, L. G., Hardham, J. M., Gao, Q., Gerber, P. F., Opriessnig, T., Zheng, Y., Li, G., Gauger, P. C., Madson, D. M., Magstadt, D. & Zhang, J. (2016). Evaluation of serological cross-reactivity and cross-neutralization between the United States porcine epidemic diarrhea virus prototype and S-INDEL-variant strains. BMC Vet Res (in revision).

Cima, G. (2014). PED virus reinfecting U.S. herds. Virus estimated to have killed 7 million-plus pigs. J Am Vet Med Assoc 245, 166-167.

Dastjerdi, A., Carr, J., Ellis, R. J., Steinbach, F. & Williamson, S. (2015). Porcine Epidemic Diarrhea Virus among Farmed Pigs, Ukraine. Emerg Infect Dis 21, 2235-2237.

Goede, D., Murtaugh, M. P., Nerem, J., Yeske, P., Rossow, K. & Morrison, R. (2015). Previous infection of sows with a "mild" strain of porcine epidemic diarrhea virus confers protection against infection with a "severe" strain. Vet Microbial 176, 161-164.

Grasland, B., Bigault, L., Bernard, C., Quenault, H., Toulouse, O., Fablet, C., Rose, N., Touzain, F. & Blanchard, Y. (2015). Complete genome sequence of a porcine epidemic diarrhea s gene indel strain isolated in france in december 2014. Genome Announc 3.

Hall, T. A. (1999). BioEdit: a user-friendly biological sequence alignment editor and analysis program for Windows 95/98/NT. Nucl Acids Symp Ser 41, 95-98.

Hanke, D., Jenckel, M., Petrov, A., Ritzmann, M., Stadler, J., Akimkin, V., Blome, S., Pohlmann, A., Schirrmeier, H., Beer, M. & Hoper, D. (2015). Comparison of porcine epidemic diarrhea viruses from Germany and the United States, 2014. Emerg Infect Dis 21, 493-496.

Huang, Y. W., Dickerman, A. W., Pineyro, P., Li, L., Fang, L., Kiehne, R., Opriessnig, T. & Meng, X. J. (2013). Origin, evolution, and genotyping of emergent porcine epidemic diarrhea virus strains in the United States. MBio 4, e00737-00713.

Jung, K., Annamalai, T., Lu, Z. & Saif, L. J. (2015a). Comparative pathogenesis of US porcine epidemic diarrhea virus (PEDV) strain PC21A in conventional 9-day-old nursing piglets vs. 26-day-old weaned pigs. Vet Microbiol 178, 31-40.

Jung, K., Eyerly, B., Annamalai, T., Lu, Z. & Saif, L. J. (2015b). Structural alteration of tight and adherens junctions in villous and crypt epithelium of the small and large intestine of conventional nursing piglets infected with porcine epidemic diarrhea virus. Vet Microbiol 177, 373-378.

Jung, K., Wang, Q., Scheuer, K. A., Lu, Z., Zhang, Y. & Saif, L. J. (2014). Pathology of US porcine epidemic diarrhea virus strain PC21A in gnotobiotic pigs. Emerg Infect Dis 20, 662-665.

Larkin, M. A., Blackshields, G., Brown, N. P., Chenna, R., McGettigan, P. A., McWilliam, H., Valentin, F., Wallace, I. M., Wilm, A., Lopez, R., Thompson, J. D., Gibson, T. J. & Higgins, D. G. (2007). Clustal W and Clustal X version 2.0. Bioinformatics 23, 2947-2948.

Lee, S. & Lee, C. (2014). Outbreak-related porcine epidemic diarrhea virus strains similar to US strains, South Korea, 2013. Emerg Infect Dis 20, 1223-1226.

Lee, S., Park, G. S., Shin, J. H. & Lee, C. (2014). Full-genome sequence analysis of a variant strain of porcine epidemic diarrhea virus in South Korea. Genome Announc 2.

Li, W., Li, H., Liu, Y., Pan, Y., Deng, F., Song, Y., Tang, X. & He, Q. (2012). New variants of porcine epidemic diarrhea virus, China, 2011. Emerg Infect Dis 18, 1350-1353.

Lin, C. M., Annamalai, T., Liu, X., Gao, X., Lu, Z., El-Tholoth, M., Hu, H., Saif, L. J. & Wang, Q. (2015a). Experimental infection of a US spike-insertion deletion porcine epidemic diarrhea virus in conventional nursing piglets and cross-protection to the original US PEDV infection. Vet Res 46, 134.

Lin, C. M., Gao, X., Oka, T., Vlasova, A. N., Esseili, M. A., Wang, Q. & Saif, L. J. (2015b). Antigenic relationships among porcine epidemic diarrhea virus and transmissible gastroenteritis virus strains. J Virol 89, 3332-3342.

Lin, C. N., Chung, W. B., Chang, S. W., Wen, C. C., Liu, H., Chien, C. H. & Chiou, M. T. (2014). US-like strain of porcine epidemic diarrhea virus outbreaks in Taiwan, 2013-2014. J Vet Med Sci 76, 1297-1299.

Liu, X., Lin, C. M., Annamalai, T., Gao, X., Lu, Z., Esseili, M. A., Jung, K., EI-Tholoth, M., Saif, L. J. & Wang, Q. (2015). Determination of the infectious titer and virulence of an original US porcine epidemic diarrhea virus PC22A strain. Vet Res 46, 109.

Lowe, J., Gauger, P., Harmon, K., Zhang, J., Connor, J., Yeske, P., Loula, T., Levis, I., Dufresne, L. & Main, R.

(2014). Role of transportation in spread of porcine epidemic diarrhea virus infection, United States. *Emerg Infect Dis* 20, 872-874.

Madson, D. M., Arruda, P. H., Magstadt, D. R., Burrough, E. R., Hoang, H., Sun, D., Bower, L. P., Bhandari, M., Gauger, P. C., Stevenson, G. W., Wilberts, B. L., Wang, C., Zhang, J. & Yoon, K. J. (2016). Characterization of Porcine Epidemic Diarrhea Virus Isolate US/Iowa/18984/ 2013 Infection in 1-Day-Old Cesarean-Derived Colostrum-Deprived Piglets. *Vet Pathol* 53, 44-52.

Madson, D. M., Magstadt, D. R., Arruda, P. H., Hoang, H., Sun, D., Bower, L. P., Bhandari, M., Burrough, E. R., Gauger, P. C., Pillatzki, A. E., Stevenson, G. W., Wilberts, B. L., Brodie, J., Harmon, K. M., Wang, C., Main, R. G., Zhang, J. & Yoon, K. J. (2014). Pathogenesis of porcine epidemic diarrhea virus isolate (US/Iowa/18984/2013) in 3-week-old weaned pigs. *Vet Microbiol* 174, 60-68.

Mesquita, J. R., Hakze-van der Honing, R., Almeida, A., Lourenco, M., van der Poel, W. H. & Nascimento, M. S. (2015). Outbreak of Porcine Epidemic Diarrhea Virus in Portugal, 2015. *Transbound Emerg Dis* 62, 586-588.

Ojkic, D., Hazlett, M., Fairies, J., Marom, A., Slavic, D., Maxie, G., Alexandersen, S., Pasick, J., Alsop, J. & Burlatschenko, S. (2015). The first case of porcine epidemic diarrhea in Canada. *Can Vet J* 56, 149-152.

Oldham, J. (1972). Letter to the editor. *Pig Farming*, Oct suppl: 72-73.

Saif, L. J. (2011). Chapter 24: Coronaviridae. In *Fenner's Veterinary Virology*, Fourth Edition edn, pp. 393-413. Edited by N. J. MacLachlan, and Dubovi E. J.: Academic Press of Elsevier.

Saif, L J., Pensaert, M. B., Sestak, K., Yeo, S. G. & Jung, K. (2012). Coronaviruses. In *Diseases of Swine*, 10th edn, pp. 501-524. Edited by J. J. Zimmerman, Karriker L. A., Ramirez A, Schwartz K. J., and Stevenson G. W.: Wiley-Blackwell.

Song, D. & Park, B. (2012). Porcine epidemic diarrhoea virus: a comprehensive review of molecular epidemiology, diagnosis, and vaccines. *Virus Genes* 44, 167-175.

Stadler, J., Zoels, S., Fux, R., Hanke, D., Pohlmann, A., Biome, S., Weissenbock, H., Weissenbacher-Lang, C., Ritzmann, M. & Ladinig, A. (2015). Emergence of porcine epidemic diarrhea virus in southern Germany. *BMC Vet Res* 11, 142.

Steinrigl, A., Revilla Fernandez, S., Stoiber, F., Pikalo, J., Sattler, T. & Schmoll, F. (2015). First detection, clinical presentation and phylogenetic characterization of Porcine epidemic diarrhea virus in Austria. *BMC Vet Res* 11, 310.

Stevenson, G. W., Hoang, H., Schwartz, K. J., Burrough, E. R., Sun, D., Madson, D., Cooper, V. L., Pillatzki, A., Gauger, P., Schmitt, B. J., Koster, L. G., Killian, M. L. & Yoon, K. J. (2013). Emergence of Porcine epidemic diarrhea virus in the United States: clinical signs, lesions, and viral genomic sequences. *J Vet Diagn Invest* 25, 649-654.

Sun, R. Q., Cai, R. J., Chen, Y. Q., Liang, P. S., Chen, D. K. & Song, C. X. (2012). Outbreak of porcine epidemic diarrhea in suckling piglets, China. *Emerg Infect Dis* 18, 161-163.

Tamura, K., Stecher, G., Peterson, D., Filipski, A. & Kumar, S. (2013). MEGA6: Molecular Evolutionary Genetics Analysis version 6.0. *Mol Biol Evol* 30, 2725-2729.

Theuns, S., Conceicao-Neto, N., Christiaens, I., Zeller, M., Desmarets, L. M., Roukaerts, I. D., Acar, D. D., Heylen, E., Matthijnssens, J. & Nauwynck, H. J. (2015). Complete genome sequence of a porcine epidemic diarrhea virus from a novel outbreak in belgium, january 2015. *Genome Announc* 3.

Thomas, J. T., Chen, Q., Gauger, P. C., Gimenez-Lirola, L. G., Sinha, A., Harmon, K. M., Madson, D. M., Burrough, E. R., Magstadt, D. R., Salzbrenner, H. M., Welch, M. W., Yoon, K. J., Zimmerman, J. J. & Zhang, J. (2015). Effect of Porcine Epidemic Diarrhea Virus Infectious Doses on Infection Outcomes in Naive Conventional Neonatal and Weaned Pigs. *PLoS One* 10, e0139266.

Van Diep, N., Norimine, J., Sueyoshi, M., Lan, N. T., Hirai, T. & Yamaguchi, R. (2015). US-like isolates of porcine epidemic diarrhea virus from Japanese outbreaks between 2013 and 2014. *Springerplus* 4, 756.

Vlasova, A. N., Marthaler, D., Wang, Q., Culhane, M. R., Rossow, K. D., Rovira, A., Collins, J. & Saif, L. J. (2014). Distinct characteristics and complex evolution of PEDV strains, North America, May 2013-February 2014. *Emerg Infect Dis* 20, 1620-1628.

Wang, L., Byrum, B. & Zhang, Y. (2014). New variant of porcine epidemic diarrhea virus, United States, 2014. *Emerg Infect Dis* 20, 917-919.

Yamamoto, R., Soma, J., Nakanishi, M., Yamaguchi, R. & Niinuma, S. (2015). Isolation and experimental inoculation of an S INDEL strain of porcine epidemic diarrhea virus in Japan. *Res Vet Sci* 103, 103-106.

Example 3

At least two genetically different porcine epidemic diarrhea virus (PEDV) strains have been identified in the United States (U.S. PEDV prototype and S-INDEL-variant strains). The current serological assays offered at veterinary diagnostic laboratories for detection of PEDV-specific antibody are based on the U.S. PEDV prototype strain. The objectives of this study were: 1) isolate the U.S. PEDV S-INDEL-variant strain in cell culture; 2) generate antisera against the U.S. PEDV prototype and S-INDEL-variant strains by experimentally infecting weaned pigs; 3) determine if the various PEDV serological assays could detect antibodies against the U.S. PEDV S-INDEL-variant strain and vice versa. A U.S. PEDV S-INDEL-variant strain was isolated in cell culture in this study. Three groups of PEDV-negative, 3-week-old pigs (five pigs per group) were inoculated orally with a U.S. PEDV prototype isolate (previously isolated in our lab), an S-INDEL-variant isolate or virus-negative culture medium. Serum samples collected at 0, 7, 14, 21 and 28 days post inoculation were evaluated by the following PEDV serological assays: 1) indirect fluorescent antibody (IFA) assays using the prototype and S-INDEL-variant strains as indicator viruses; 2) virus neutralization (VN) tests against the prototype and S-INDEL-variant viruses; 3) PEDV prototype strain whole virus based ELISA; 4) PEDV prototype strain S1-based ELISA; and 5) PEDV S-INDEL-variant strain S1-based ELISA. The positive antisera against the prototype strain reacted to and neutralized both prototype and S-INDEL-variant viruses, and the positive antisera against the S-INDEL-variant strain also reacted to and neutralized both prototype and S-INDEL-variant viruses, as examined by IFA antibody assays and VN tests. Antibodies against the two PEDV strains could be detected by all three ELISAs although detection rates varied to some degree.

Applicants show that the antibodies against U.S. PEDV prototype and S-INDEL-variant strains cross-reacted and cross-neutralized both strains in vitro. The current serological assays based on U.S. PEDV prototype strain can detect antibodies against both U.S. PEDV strains.

Porcine epidemic diarrhea (PED), caused by porcine epidemic diarrhea virus (PEDV), was first recorded in England in the early 1970s and has since spread to other European and Asian countries [1]. In North America, PEDV was detected for the first time in the United States (U.S.) in April 2013 [2] and subsequently PEDV was reported in Canada [3] and Mexico [4]. PEDV is an enveloped, single-stranded, positive-sense RNA virus belonging to the order Nidovirale, the family Coronaviridae, subfamily Coronavirinae, genus *Alphacoronavirus* [5]. The PEDV genome is approximately 28 kb in length and includes ORF1a and ORF1b encoding the replicase polyproteins and other opening reading frames (ORFs) encoding four structural proteins [spike (S), envelope (E), membrane (M), and nucleocapsid (N)] and one nonstructural protein NS3B (encoded by ORF3) [1].

In the U.S., a highly virulent PEDV strain (U.S. PEDV prototype strain) was identified during the initial PED outbreaks [2, 6, 7]. Lately, a PEDV variant strain having insertions and deletions (INDEL) in the spike gene compared to the U.S. prototype strain was identified in U.S. swine with mild clinical signs based on field observations [8]. This U.S. PEDV variant strain, also known as S INDEL strain [4], formed a distinct phylogenetic cluster compared to U.S. PEDV prototype strains [4, 8, 9]. One PEDV isolate (PC177) having a 197-aa deletion in the N-terminal S protein was discovered during PEDV isolation in cell culture; however, this PEDV isolate still phylogenetically clustered with the U.S. PEDV prototype strains and was not considered as one of the S-INDEL-variant strains [10]. Marthaler et al [11] reported a 'third' strain of PEDV (Minnesota188) in U.S. swine that had 6 nucleotide deletions (2 amino acid deletions) in the spike gene (different from the U.S. S-INDEL-variant strains). However, the PEDV Minnesota188 was genetically very closely related to the U.S. PEDV prototype strains and it is arguable whether it should be called a 'third' strain of PEDV in U.S. The PEDV PC177 and Minnesota188 are probably the mutants of the U.S. PEDV prototype strains. Therefore, there are at least two genetically different PEDV strains currently circulating in U.S. swine: U.S. PEDV prototype strain and S-INDEL-variant strain.

The U.S. PEDV prototype strains have been successfully isolated and propagated in cell culture by several groups [7, 10, 12, 13]. A number of serological assays, including an indirect fluorescent antibody (IFA) assay, a virus neutralization (VN) test, a whole virus-based enzyme-linked immunosorbent assay (ELISA), a recombinant S1 protein-based ELISA, and recombinant nucleocapsid protein-based ELISAs, have been developed for the detection of PEDV-specific antibodies [14-18]. All of these serological assays are based on the U.S. PEDV prototype strains.

In this study, Applicants isolate a U.S. PEDV S-INDEL-variant strain in cell culture. Pigs were experimentally inoculated with a U.S. PEDV prototype strain and the newly isolated U.S. PEDV S-INDEL-variant strain, respectively, to generate strain-specific antisera. Subsequently, the generated swine antisera were subjected to an in vitro evaluation for serological cross-reactivity and cross-neutralization between the two strains. Specifically, 1) PEDV IFA antibody assays (using the prototype and S-INDEL-variant strains as indicator viruses, respectively) and ELISAs (PEDV prototype strain whole virus-based ELISA, PEDV prototype strain S1-based ELISA, and PEDV S-INDEL-variant strain S1-based ELISA) were conducted to evaluate the antibody cross-reactivity of the two U.S. strains; and 2) VN tests using the prototype and S-INDEL-variant strains as indicator viruses were conducted to evaluate the in vitro cross-neutralization of two U.S. strains.

Materials and Methods

Isolation of U.S. PEDV S-INDEL-Variant Strain in Cell Culture.

Sixty-eight clinical samples (27 fecal swabs, 24 feces, 13 small intestines and 4 oral fluids), which were tested positive by a PEDV N gene-based real-time RT-PCR [17, 19] at the Iowa State University Veterinary Diagnostic Laboratory (ISU VDL) and confirmed positive for the U.S. PEDV S-INDEL-variant strain but negative for the U.S. prototype strain by S1 sequencing, were selected to attempt virus isolation in Vero cells (ATCC CCL-81) following previously described procedures [7].

Among the aforementioned 68 clinical samples positive for the U.S. PEDV S-INDEL-variant strain, one small intestine homogenate (with PEDV N gene-based real-time RT-PCR cycle threshold (Ct) value of 16.1) [17, 19] from a pig located in Illinois was inoculated orogastrically into three PEDV-naïve weaned pigs at 3 weeks of age (10 ml per pig). The homogenate used for inoculation was confirmed negative for transmissible gastrointestinal virus (TGEV), porcine rotavirus groups A, B, C and porcine deltacoronavirus (PDCoV) by virus-specific RT-PCRs at the ISU VDL. Rectal swabs and feces were collected from each inoculated pig twice a day and tested by the PEDV real-time RT-PCR on the same day. Once the RT-PCR Ct values of the rectal swabs were <15, the pig was euthanized and necropsied within 24 hours. Small intestine tissues and cecum contents were collected for attempting virus isolation in cell culture as previously described [7]. This animal study was performed according to the procedures approved by the Iowa State University Institutional Animal Care and Use Committee (IACUC, approval number 3-14-7766-S).

The whole genome sequence of the U.S. PEDV S-INDEL-variant strain cell culture isolate USA/IL20697/2014 obtained in this study was determined by next-generation sequencing (NGS) technology using an Illumina MiSeq platform as described previously [7]. The PEDV S1 portion sequences of the isolate USA/IL20697/2014 and the clinical sample from which the virus isolate was derived were determined by Sanger sequencing following the previously described procedures [7].

Generation of Antisera Against the U.S. Prototype and S-INDEL-Variant PEDVs.

Fifteen 3-week-old pigs, negative for PEDV as confirmed by a real-time RT-PCR on rectal swabs and by IFA antibody assay on sera, were randomly divided by weight into 3 groups with 5 pigs per group and with similar average weight per group. After acclimation for 3 days, three groups of pigs were orogastrically inoculated with a U.S. PEDV prototype cell culture isolate USA/IN19338/2013-P7 (Pro group) (SEQ ID NO:59) [7], a U.S. PEDV S-INDEL-variant cell culture isolate USA/IL20697/2014-P7 (SEQ ID NO:62) (Var group), and virus-negative culture medium (Neg group), respectively, with virus titers of 104 TCID50/ml, 10 ml per pig. Rectal swabs were collected from all pigs daily between 0 and 7 DPI, and then at 10, 14, 21 and 28 DPI, and tested by a PEDV N gene-based quantitative real-time RT-PCR [20] to confirm infection. Serum samples were collected from all pigs at 0, 7, 14, 21 and 28 days post inoculation (DPI) for cross-reactivity and cross-neutralization evaluations. This animal study was performed according to the procedures approved by the Iowa State University IACUC committee (approval number 6-14-7809-S).

Twenty-five serum samples collected at 0, 7, 14, 21, and 28 DPI from the Pro group (Pro antisera), 25 serum samples collected from the Var group (Var antisera), and 25 serum samples collected from the Neg group (Neg antisera), were tested by various serological assays in this study. In addition, one pig antiserum against the European PEDV CV777 strain, one pig antiserum against the TGEV Purdue strain, one pig antiserum against the porcine heamagglutinating encephalomyelitis virus (PHEV), one pig antiserum against the porcine respiratory coronavirus (PRCV), and one pig antiserum against PDCoV were included in this study for evaluations. Antisera against PEDV CV777, TGEV Purdue, and PHEV strains were purchased from National Veterinary Service Laboratory, Ames, Iowa Antisera against PRCV and PDCoV were positive control sera obtained from the ISU VDL.

Indirect Fluorescent Antibody (IFA) Assay.

Eighty serum samples were tested by the PEDV prototype strain-based IFA (Pro IFA) and S-INDEL-variant strain-based IFA (Var IFA) following the previously described procedures [20]. The PEDV prototype isolate USA/IN19338/2013 was used as the indicator virus in the Pro IFA assay and the S-INDEL-variant isolate USA/IL20697/2014 was used as the indicator virus in the Var IFA assay. A positive signal at a serum dilution of 1:40 or higher was considered to be IFA antibody positive.

PEDV ELISAs for Antibody Detection.

The U.S. PEDV prototype strain whole virus-based indirect ELISA (ProWV ELISA) was developed and validated at the ISU VDL for detection of PEDV-specific IgG antibody [15, 16]. All serum samples were tested by this ProWV ELISA following the procedures that had been described in detail [20]. The sample-to-positive (S/P) ratio of >0.8 was considered antibody positive, an S/P ratio between 0.6-0.8 was considered suspect, and an S/P ratio <0.6 was considered negative.

A published U.S. PEDV prototype strain S1-based indirect ELISA (ProS1 ELISA) was used to test all the serum samples in this study following the previously described procedures [14]. The S/P ratio of >0.2 was considered antibody positive, 0.14-0.2 was considered suspect, and an S/P ratio <0.14 was considered negative.

A U.S. PEDV S-INDEL-variant strain S1-based indirect ELISA (VarS1 ELISA) was developed in this study. The region encoding the S1 portion (aa 1-735) of the U.S. PEDV S-INDEL-variant strain was codon optimized and synthesized with the addition of a 5' Kozac sequence, a 5' eukaryotic signal sequence, and a 3' 6x-His tag by GeneArt® Gene Synthesis (Thermo Fisher Scientific, Waltham, Mass., USA). The resultant 2,358 base pair DNA fragment was cloned into a Zoetis proprietary eukaryotic expression vector (pZOE15). The authenticity and orientation of the insert in the recombinant plasmid was confirmed by sequencing. The recombinant plasmid was transiently transfected into human embryonic kidney (HEK) 293 cells using a Zoetis proprietary PEI transfection method. At 7 days post-transfection, culture supernatants were harvested and filter sterilized. The recombinant protein was purified via Ni-NTA Purification System (Thermo Fisher Scientific). The optimum antigen concentration and the optimum serum dilutions for the VarS1 ELISA were determined using a checkerboard titration. Polystyrene 96-well microtitration plates (Nunc®, Thermo Fisher Scientific) were coated (100 µl per well) with PEDV variant 51 protein and incubated overnight at 4° C. After 5 washes with PBS, the plates were blocked (300 µl/well) with PBS containing 1% bovine serum albumin (Jackson ImmunoResearch Inc., West Grove, Pa., USA) for 2 h at 25° C. Plates were dried at 37° C. for 4 h and stored at 4° C. in a sealed bag with desiccant packs until use. Serum samples were diluted 1:50 and added to the coated plates (100 µl/well). Plates were incubated at 25° C. for 1 h and then washed 5 times with PBS. Subsequently 100 µl of peroxidase-conjugated goat anti-porcine IgG (H+L) (Jackson ImmunoResearch Inc., West Grove, Pa., USA) at 1:25,000 dilution was added and plates were incubated at 25° C. for 1 h. After a washing step, 100 µl tetramethylbenzidine-hydrogen peroxide substrate (TMB, Dako North America Inc., Carpinteria, Calif., USA) was added. Plates were incubated at room temperature for 5 min and the reaction was stopped by adding 50 µl stop solution (1 M sulfuric acid). Reactions were measured as optical density (OD) at 450 nm using an ELISA plate reader operated with commercial software (Biotek® Instruments Inc., Winooski, Vt., USA). The serum antibody response was presented as sample-to-positive (S/P) ratios calculated as: S/P ratio= (sample OD−negative control mean OD)/(positive control mean OD−negative control mean OD). The PEDV VarS1 ELISA was validated using 29 field serum samples collected from a farm with documented exposure to the U.S. PEDV S-INDEL-variant strain (serum samples were collected from 29 weaned pigs one month after they were found positive for S-INDEL-variant strain by PCR) and 20 PEDV-negative field serum samples. The S/P ratio of >0.3 was considered antibody positive, 0.2-0.3 was suspect, and <0.2 was negative.

Virus Neutralization (VN) Test.

Serum samples were tested by a U.S. PEDV prototype strain-based VN (Pro VN) and a U.S. PEDV S-INDEL-variant strain-based VN (Var VN) following the previously described procedures [20]. The PEDV prototype isolate USA/IN19338/2013 was used as the indicator virus in the Pro VN assay and the S-INDEL-variant isolate USA/IL20697/2014 was used as the indicator virus in the Var VN assay. The reciprocal of the highest serum dilution resulting in >90% reduction of staining as compared to the negative serum control was defined as the VN titer of the serum sample. A VN titer of >8 was considered positive.

Statistical Analysis.

The Log 2 (IFA titer/10) of the Pro antisera and the Var antisera tested by Pro IFA and Var IFA were analyzed in a generalized linear mixed model (GLIMMIX). Days post inoculation and antigen were used as independent variables, and pig ID and the interaction of pig ID and antigen were set as random effects. The Log 2 (VN titer) of the Pro antisera and the Var antisera tested by Pro VN and Var VN were analyzed in a similar way. For ELISA analysis, ELISA antigen, pig ID and DPI were used as independent variables. All statistical analyses were performed with Statistical Analysis System (SAS) version 9.3 (SAS institute, Cary, N.C., USA), with p value <0.05 considered significantly different.

Results

Isolation of the U.S. PEDV S-INDEL-Variant Strain in Cell Culture.

Virus isolation was first attempted on 68 clinical samples received at the ISU VDL that tested positive for the U.S. PEDV S-INDEL-variant strain but virus isolation attempts in cell culture were unsuccessful. Subsequently a PEDV S-INDEL-variant strain-positive intestine homogenate was used to inoculate three 3-week-old pigs. The rectal swab of one pig had a PEDV RT-PCR Ct<15 at 2 DPI and the pig was euthanized and necropsied at 3 DPI. The rectal swabs of the other two pigs had PEDV RT-PCR Ct<15 at 3 DPI and both pigs were euthanized and necropsied at 4 DPI. The small intestine tissues and cecum contents collected at necropsy were used to attempt virus isolation in Vero cells. The U.S.

PEDV S-INDEL-variant strain was successfully isolated from small intestine homogenates and cecum contents collected from all 3 pigs. Typical PEDV cytopathic effects including syncytial body formation and cell detachment were observed and the virus growth was confirmed by immunofluorescence staining using PEDV-specific monoclonal antibody SD6-29.

One U.S. PEDV S-INDEL-variant isolate designated as USA/IL20697/2014 was selected for further propagation and characterization. This isolate was serially passed in Vero cells and the infectious titers ranged from 103-105 TCID50/ml for the first ten passages. The whole genome sequences of the isolate 2014020697-P5 passage 5, lineage 1 (SEQ ID NO:8) had 99.3-99.9% nucleotide identity to other U.S. PEDV S-INDEL-variant sequences available in GenBank. The S1 sequences of the USA/IL20697/2014 cell culture isolate P5 had 99.8% nucleotide identity (only 4 nucleotide differences) to the original intestine homogenate from which the virus isolate was derived. The USA/IL20697/2014 isolate was tested at the ISU VDL and confirmed negative for TGEV, PRCV, PDCoV, porcine rotavirus A, B, C, influenza A virus, porcine reproductive and respiratory syndrome virus, and porcine circovirus 2 by virus-specific PCRs.

Generation of Antisera Against the U.S. Prototype and S-INDEL-Variant PEDVs.

The U.S. PEDV prototype isolate USA/IN19338/2013-P7 (SEQ ID NO:59) and S-INDEL-variant isolate 2014020697-P7 (SEQ ID NO:62) became established in all inoculated pigs as evidenced by PCR testing of the rectal swabs. In prototype group, 4/5, 5/5, 5/5, 5/5, 5/5, 5/5, and 3/5 pigs shed the virus in rectal swabs at 2, 4, 7, 10, 14, 21, and 28 DPI, respectively, as tested by PEDV real-time RT-PCR. In S-INDEL-variant group, 3/5, 5/5, 5/5, 5/5, 4/5, 3/5 and 1/5 pigs shed the virus in rectal swabs at 2, 4, 7, 10, 14, 21 and 28 DPI, respectively. The rectal swabs of the negative control pigs remained PEDV PCR negative throughout the study period. In total, 25 antisera were collected from the prototype strain-inoculated pigs (Pro antisera), 25 antisera collected from the variant strain-inoculated pigs (Var antisera), and 25 antisera collected from negative control group (Neg antisera), at 0, 7, 14, 21, and 28 DPI.

Evaluation of Cross-Reactivity of Antibodies Against the U.S. PEDV Prototype Strain and S-INDEL-Variant Strain by PEDV IFA Antibody Assays.

As shown in FIG. 13, the Pro antisera tested antibody negative (0/5) at 0 and 7 DPI and 100% positive (5/5) at 14, 21, and 28 DPI by the prototype strain-based IFA antibody assay (Pro IFA). The variant strain-based IFA (Var IFA) gave similar results on the Pro antisera except that one serum collected at 14 DPI was negative by the Var IFA assay. When the antibody titers were compared, the positive Pro antisera overall reacted better to the Pro IFA assay than to the Var IFA assay, with 1.4 log 2 higher titer on average (FIG. 13).

The Var antisera tested negative (0/5) at 0 and 7 DPI and 100% positive (5/5) at 14, 21, and 28 DPI by both the Pro IFA and Var IFA antibody assays. When the antibody titers were compared, the positive Var antisera reacted similarly to both Pro IFA and Var IFA assays, with less than 0.1 log 2 titer differences on average (FIG. 13).

The antisera collected from the negative control group (Neg antisera) were antibody negative by both PEDV Pro IFA and Var IFA assays throughout the study. The pig antiserum against the European PEDV CV777 strain had similar antibody titers by the Pro IFA assay (titer 320) and by the Var IFA assay (titer 160). The antisera against TGEV Purdue, PHEV, PDCoV, and PRCV viruses were all negative by both PEDV Pro IFA and Var IFA assays.

Evaluation of Cross-Reactivity of Antibodies Against the U.S. PEDV Prototype Strain and S-INDEL-Variant Strain by Various PEDV ELISAs.

As shown in FIG. 14, the Pro antisera collected at 0 and 7 DPI were all antibody negative by ProWV ELISA, ProS1 ELISA, and VarS1 ELISA. For the Pro antisera collected at 14 DPI, 2 sera were positive and 3 were in the suspect range by the ProWV ELISA; 3 positives and 1 suspect by the ProS1 ELISA; 2 positives and 1 suspect by the VarS1 ELISA. The Pro antisera collected at 21 and 28 DPI were all positive by three ELISAs. When comparing the total number of positive Pro antisera at 14, 21 and 28 DPI by each ELISA, there were no significant differences among three ELISAs to detect antibody against the U.S. PEDV prototype strain.

The Var antisera collected at 0 and 7 DPI were antibody negative by all three ELISAs, with the exception of one serum at 7 DPI that was in the suspect range by the ProS1 ELISA (FIG. 14). The Var antisera collected at 14, 21 and 28 DPI had variable numbers of positive, suspect and negative results by three ELISAs (FIG. 14). Overall for the Var antisera, the ProWV ELISA detected 14 sera as antibody positive, 1 as suspect, and 10 as negative; the ProS1 ELISA detected 8 sera as positive, 5 as suspect, and 12 as negative; the VarS1 ELISA detected 12 sera as positive, 3 as suspect, and 10 as negative. When comparing the total number of positive Var antisera at 14, 21 and 28 DPI by each ELISA, the ProWV ELISA was significantly better than the ProS1 ELISA to detect antibody against the U.S. PEDV S-INDEL-variant strain (p=0.0079). However, there were no significant differences between the ProWV ELISA and VarS1 ELISA (p=0.3643), or between the ProS1 ELISA and VarS1 ELISA (p=0.0723), to detect antibody against the U.S. PEDV S-INDEL-variant strain.

The antisera collected from the negative control group (Neg antisera) were antibody negative by all three PEDV ELISAs throughout the study period 0-28 DPI. The pig antiserum against the European PEDV CV777 strain was antibody positive by all three PEDV ELISAs. The antisera against TGEV Purdue, PHEV, PDCoV, and PRCV viruses were all negative by three PEDV ELISAs.

Evaluation of Cross-Neutralization of Antibodies Against the U.S. PEDV Prototype Strain and S-INDEL-Variant Strain by Virus Neutralization Tests.

As shown in FIG. 15, VN antibodies were detected as early as 7 DPI in sera of most of the pigs inoculated with either a prototype strain or an S-INDEL-variant strain, regardless of testing by Pro VN or Var VN assays. Serum samples collected at 14, 21 and 28 DPI from all pigs inoculated with PEDV prototype strain or S-INDEL-variant strain were VN antibody positive by both Pro VN and Var VN assays.

The positive Pro antisera had similar VN antibody titers by the Pro VN and Var VN assays and there was no significant difference between the two assays. The positive Var antisera had similar VN antibody titers by the Pro VN and Var VN assays and overall there was no significant difference between the two assays (p=0.42) although the average VN antibody titers of Var antisera at 21 and 28 DPI were slightly higher by the Var VN assay than by the Pro VN assay (FIG. 15).

The VN antibody titers of the positive Pro antisera tested by the homologous Pro VN assay were, on average, 0.8 log 2 higher than the VN antibody titers of the positive Var antisera tested by the homologous Var VN assay (FIG. 15).

The antisera collected from the negative control group (Neg antisera) were antibody negative by both Pro VN and Var VN assays throughout the study period 0-28 DPI. The pig antiserum against the European PEDV CV777 strain was antibody positive by the Pro VN assay (titer 64) and by the Var VN assay (titer 16). The antisera against TGEV Purdue, PHEV, PDCoV, and PRCV viruses were all negative by both PEDV Pro VN and Var VN assays.

DISCUSSION

Applicants previously isolated the U.S. PEDV prototype strains in Vero cells [7]. In order to obtain a cell culture isolate of U.S. PEDV S-INDEL-variant strains to generate strain-specific antisera for evaluation, virus isolation was first attempted in Vero cells using 68 PEDV S-INDEL-variant strain-positive clinical samples submitted to the ISU VDL. However, it was unsuccessful to isolate an S-INDEL-variant virus in cell culture from these samples. This could be due to multiple factors such as low concentration of virus in samples, cytotoxicity of some samples, and variable storage conditions of the clinical samples after collection. Next, among the 68 clinical samples, one intestine homogenate containing the S-INDEL-variant PEDV was inoculated into pigs to generate more fresh materials with abundant virus load for virus isolation attempts in cell culture. Using this approach, U.S. S-INDEL-variant PEDV was successfully isolated in Vero cells. It is speculated that high concentration of virus in the samples and immediate virus isolation attempts on the fresh samples are the key to success of virus isolation in cell culture. For other viruses under occasions that there is difficulty to isolate those viruses in cell cultures directly from the clinical samples of naturally infected animals, the approach described in this study can be considered, namely amplifying the virus in host animals to obtain fresh samples with high concentration of virus for virus isolation attempts in cell cultures.

Some field serum samples collected from swine farms were submitted to the ISU VDL for PEDV antibody detection. However, due to the lack of clear exposure history of these cases as well as the possibility of infection with multiple pathogens or with more than one PEDV strain, these field serum samples were not ideal for evaluating serological cross-reactivity of different PEDV strains. Therefore, in the present study, antisera against the U.S. PEDV prototype and S-INDEL-variant strains were generated in weaned pigs under strict experimental conditions, for evaluation of cross-reactivity by various serological assays.

The positive antisera against the prototype strain reacted with both prototype and S-INDEL-variant viruses, and the positive antisera against the S-INDEL-variant strain also reacted with both prototype and S-INDEL-variant viruses, as examined by IFA antibody assays. When taking the antibody titers into consideration, antibodies against the prototype strain reacted better to the Pro IFA assay than to the Var IFA assay whereas antibodies against the S-INDEL-variant strain reacted similarly to the Var IFA and Pro IFA assays. Thus, the current U.S. PEDV prototype strain-based WA antibody assay offered at veterinary diagnostic laboratories can be used to reliably detect antibodies against both U.S. PEDV strains.

The ProWV ELISA and ProS1 ELISA have been previously developed and validated to detect PEDV-specific antibodies [14-16]. A PEDV VarS1 ELISA was developed in this study. However, this VarS1 ELISA was only validated using a limited number of field antisera against the U.S. PEDV S-INDEL-variant strain before testing the experimentally generated antisera in this study. Further validation of this VarS1 ELISA using large number of serum samples would be needed to determine the performance of this assay.

All three PEDV ELISAs reacted with the Pro antisera and Var antisera. The three ELISAs detected Pro antisera similarly. However, it appeared that the ProS1 ELISA used in this study was not as efficient as the ProWV ELISA and the VarS1 ELISA to detect the antibodies against the U.S. PEDV S-INDEL-variant strain under the conditions of this study.

The antibodies against the U.S. prototype strain and the antibodies against the U.S. S-INDEL-variant strain neutralized both virus strains to similar titers. The U.S. PEDV prototype strain-based VN tests currently run in the laboratories can be used to detect antibodies against both U.S. PEDV strains.

Both the prototype and S-INDEL-variant PEDV-inoculated pigs developed detectable IFA and ELISA antibodies in sera starting from 14 DPI in this study. In contrast, both groups of pigs developed low levels of serum neutralizing antibodies starting from 7 DPI. The IFA and ELISA assays in this study detected IgG antibodies; the VN tests could potentially detect any antibody isotype with neutralizing activity. It is unclear whether this contributes to the observed early detection of low-level VN antibody. In a previous study, it has also been reported that PEDV VN antibody could be detected as early as 7 DPI [20].

The distinct genetic differences between the U.S. prototype and S-INDEL-variant PEDVs are located in the S1 region (nucleotides 1-2214 corresponding to aa 1-738, according to positions in the prototype strain USA/IN19338/2013, GenBank accession number KF650371), especially the N-terminal region of the S gene (nucleotides 1-1170 corresponding to aa 1-390) whereas the remaining portions of the genomes are relatively conserved between the two U.S. strains [4, 8, 10]. The PEDV prototype strain S1 protein used for the ProS1 ELISA and the PEDV S-INDEL-variant strain S1 protein used for the VarS1 ELISA had 92% amino acid identity. The reported PEDV neutralizing epitopes are located in the S protein amino acid residues 499-638, 744-759, 756-771, and 1368-1374 [1, 21]. The protein sequences in these locations harboring the neutralizing epitopes are conserved between the U.S. prototype and S-INDEL-variant PEDVs. This can explain why the antibodies against the two PEDV strains were able to cross-neutralize two virus strains. The ProS1 and VarS1 ELISAs were developed using the recombinant PEDV S1 proteins (aa 1-738). Although the U.S. prototype and S-INDEL-variant PEDVs have considerable differences in aa 1-390, the two strains still have some common epitopes in this region. In addition, the recombinant S1 proteins of two PEDV strains have relatively conserved sequences from aa 390-738 including the neutralizing epitopes in this region. These may be the reasons why the ProS1 and VarS1 ELISAs can detect antibodies against both U.S. PEDV strains despite of possible differences on the sensitivity between assays. The IFA antibody assay and ProWV ELISA are supposed to detect antibodies against multiple antigenic proteins of PEDV and thus they are expected to detect antibodies against both U.S. prototype and S-INDEL-variant PEDVs. Considering that the nucleocapsid protein is rather conserved among PEDVs, it is expected that the nucleocapsid protein-based ELISAs should detect antibodies against both U.S. PEDV strains. Applicants also included one pig antiserum against the classical European PEDV CV777 strain for evaluation and the PEDV CV777 antibody was detected by all serological assays evaluated in this study. However, antisera against TGEV Purdue, PHEV, PDCoV and PRCV had no cross-reactivity with PEDV serological assays evaluated in this study.

Lin et al [22], hyperimmune pig antisera against U.S. PEDV prototype strain, U.S. PEDV S-INDEL-variant strain, TGEV Purdue strain, and TGEV Miller strain were generated and tested by cell culture immunofluorescence (CCIF) assay (similar to our IFA antibody assay) and fluorescent focus reduction virus neutralization (FFRVN) assay (similar to our VN test). It was found that antisera against the U.S. PEDV prototype strain, S-INDEL-variant strain, and European CV777 strain all had cross-reactivity by CCIF and FFRVN assays. Our findings are consistent with their results. In addition to similar serological assays used by Lin et al, we also evaluated PEDV serological reactivity via three PEDV ELISAs. Also, we tested sequential serum samples (0-28 DPI) from pigs experimentally infected with two U.S. PEDV strains, providing useful information about the kinetics of PEDV antibody production in weaned pigs. An interesting finding in the Lin et al study was that hyperimmune antisera against TGEV Miller strain rather than TGEV Purdue strain cross-reacted with all PEDV strains by CCIF assay but not by FFRVN assay.

CONCLUSIONS

The data in the present study indicate that the antibodies against U.S. PEDV prototype and S-INDEL-variant strains cross-reacted and cross-neutralized both strains in vitro. The current serological assays based on U.S. PEDV prototype strain can detect antibodies against both U.S. PEDV strains. However, the cross-protection efficacy of these two PEDV strains needs to be determined by in vivo pig studies. Goede et al [23] showed that sows exposed to S-INDEL-variant PEDV infection 7 months ago could provide partial protection to newborn piglets challenged with a U.S. PEDV prototype strain. But more in vivo studies in this respect are needed to reveal whether a U.S. PEDV prototype strain or the S-INDEL-variant strain or both should be used to develop a vaccine for providing protection against both PEDV strains circulating in U.S. swine (see Examples 5 and 6 for additional work to this regard).

REFERENCES

1. Song D, Park B. 2012. Porcine epidemic diarrhoea virus: a comprehensive review of molecular epidemiology, diagnosis, and vaccines. Virus Genes 44:167-175.
2. Stevenson G W, Hoang H, Schwartz K J, Burrough E R, Sun D, Madson D, Cooper V L, Pillatzki A, Gauger P, Schmitt B J, Koster L G, Killian M L, Yoon K J. 2013. Emergence of Porcine epidemic diarrhea virus in the United States: clinical signs, lesions, and viral genomic sequences. J Vet Diagn Invest 25:649-654.
3. Pasick J, Berhane Y, Ojkic D, Maxie G, Embury-Hyatt C, Swekla K, Handel K, Fairies J, Alexandersen S. 2014. Investigation into the role of potentially contaminated feed as a source of the first-detected outbreaks of porcine epidemic diarrhea in Canada. Transbound Emerg Dis 61:397-410.
4. Vlasova A N, Marthaler D, Wang Q, Culhane M R, Rossow K D, Rovira A, Collins J, Saif U. 2014. Distinct Characteristics and Complex Evolution of PEDV Strains, North America, May 2013-February 2014. Emerg Infect Dis 20.
5. International Committee on Taxonomy of Viruses. 2012. Virus Taxonomy: 2012 Release. wold wide web at ictvonline.org/virusTaxonomy.asp?version=2012.
6. Huang Y W, Dickerman A W, Pineyro P, Li L, Fang L, Kiehne R, Opriessnig T, Meng X J. 2013. Origin, evolution, and genotyping of emergent porcine epidemic diarrhea virus strains in the United States. MBio 4:e00737-00713.
7. Chen Q, Li G, Stasko J, Thomas J T, Stensland W R, Pillatzki A E, Gauger P C, Schwartz K J, Madson D, Yoon K J, Stevenson G W, Burrough E R, Harmon K M, Main R G, Zhang J. 2014. Isolation and characterization of porcine epidemic diarrhea viruses associated with the 2013 disease outbreak among swine in the United States. J Clin Microbiol 52:234-243.
8. Wang L, Byrum B, Zhang Y. 2014. New variant of porcine epidemic diarrhea virus, United States, 2014. Emerg Infect Dis 20:917-919.
9. Zhang J, Chen Q, Gauger P C, Harmon K M, Yoon K J. 2014. Reply to "classification of emergent U.S. strains of porcine epidemic diarrhea virus by phylogenetic analysis of nucleocapsid and ORF3 genes". J. Clin Microbiol 52:3511-3514.
10. Oka T, Saif U, Marthaler D, Esseili M A, Meulia T, Lin C M, Vlasova A N, Jung K, Zhang Y, Wang Q. 2014. Cell culture isolation and sequence analysis of genetically diverse U S porcine epidemic diarrhea virus strains including a novel strain with a large deletion in the spike gene. Vet Microbiol 173:258-269.
11. Marthaler D, Bruner L, Collins J, Rossow K. 2014. Third strain of porcine epidemic diarrhea virus, United States. Emerg Infect Dis 20:2162-2163.
12. Hoang H, Killian M L, Madson D M, Arruda P H, Sun D, Schwartz K J, Yoon K J. 2013. Full-Length Genome Sequence of a Plaque-Cloned Virulent Porcine Epidemic Diarrhea Virus Isolate (USA/lowa/18984/2013) from a Midwestern U.S. Swine Herd. Genome Announc 1.
13. Lawrence P K, Bumgardner E, Bey R F, Stine D, Bumgarner R E. 2014. Genome sequences of porcine epidemic diarrhea virus: in vivo and in vitro phenotypes. Genome Announc 2.
14. Gerber P F, Gong Q, Huang Y W, Wang C, Holtkamp D, Opriessnig T. 2014. Detection of antibodies against porcine epidemic diarrhea virus in serum and colostrum by indirect ELISA. Vet J 202:33-36.
15. Gimenez-Lirola L G. 2014. Porcine epidemic diarrhea virus antibody tests available at ISU VDL, Swine Health Monitoring Projecct, Sep. 26, 2014 ed.
16. Gimenez-Lirola L G, Baum D, Bower L, Chen Q Sun D, Johnson J, Kalkwarf E, Madson D, Magtoto R, Yoon K J, Zhang J, Zimmerman J, Main R. 2014. Porcine epidemic diarrhea virus: antibody-based test development, p. 34-37, The 22 nd Annual Swine Disease Conference for Swine Practitioners, Ames, Iowa. Nov. 13-14, 2014.
17. Madson D M, Magstadt D R, Arruda P H, Hoang H, Sun D, Bower L P, Bhandari M, Burrough E R, Gauger P C, Pillatzki A E, Stevenson G W, Wilberts B L, Brodie J, Harmon K M, Wang C, Main R G, Zhang J, Yoon K J. 2014. Pathogenesis of porcine epidemic diarrhea virus isolate (US/Iowa/18984/2013) in 3-week-old weaned pigs. Vet Microbiol 174:60-68.
18. Okda F, Liu X, Singrey A, Clement T, Nelson J, Christopher-Hennings J, Nelson E A, Lawson S. 2015. Development of an indirect ELISA, blocking ELISA, fluorescent microsphere immunoassay and fluorescent focus neutralization assay for serologic evaluation of exposure to North American strains of Porcine Epidemic Diarrhea Virus. BMC Vet Res 11:180.
19. Fan J H, Zuo Y Z, Shen X Q, Gu W Y, Di J M. 2015. Development of an enzyme-linked immunosorbent assay for the monitoring and surveillance of antibodies to porcine epidemic diarrhea virus based on a recombinant membrane protein. J Virol Methods.
20. Thomas J T, Chen Q Gauger P C, Gimenez-Lirola L G, Sinha A, Harmon K M, Madson D M, Burrough E R, Magstadt D R, Salzbrenner H M, Welch M W, Yoon K J, Zimmerman J J, Zhang J. 2015. Effect of porcine epidemic diarrhea virus infectious doses on infection outcomes in naive neonatal and weaned pigs. PLoS One (submitted).
21. Sun D, Feng L, Shi H, Chen J, Cui X, Chen H, Liu S, Tong Y, Wang Y, Tong G. 2008. Identification of two novel B cell epitopes on porcine epidemic diarrhea virus spike protein. Vet Microbiol 131:73-81.
22. Un C M, Gao X, Oka T, Viasova A N, Esseili M A, Wang Q Saif U. 2015. Antigenic relationships among porcine epidemic diarrhea virus and transmissible gastroenteritis virus strains. J Virol 89:3332-3342.
23. Goede D, Murtaugh M P, Nerem J, Yeske P, Rossow K, Morrison R. 2015. Previous infection of sows with a "mild" strain of porcine epidemic diarrhea virus confers protection against infection with a "severe" strain. Vet Microbiol 176:161-164.

Example 4

In response to current major epidemics of PEDV, and the lack of effective vaccines, the present invention provides a major achievement, the provision of modified live vaccines, based on INDEL-type variants (a further example of which being OH851, as first described by the Ohio Department of Agriculture, L. Wang et al., Emerg. Infect. Dis., 2014, v. 20, pp. 917-919) that are effective against the current spectrum of worldwide epidemics, and particularly are cross protective against so-called prototype viruses (an example being well known USA/Colorado/2013, the sequence of which is available under GenBank Accession No. KF272920), all as generally described above, which have caused devastating losses in swine herds. The completely novel, first in class, vaccines of the present invention also accord substantial flexibility as to dosing, and timing of dosing, being effective for administration, for example, to sows, both before and during pregnancy, and for administration to piglets, including to those born of naïve sows. Effectiveness as to boars is also provided. As a result, such vaccines, in both adjuvanted and non-adjuvanted forms, provide protection to sows, gilts, piglets, hogs and boars against challenge with PEDV, including prototype and emerging INDEL-type isolates. The present vaccines will therefore provide previously unattainable protective benefits, to include the achievement successful (1) vaccination of pregnant sows and gilts for protection, prevention, aid in prevention, or aid in control against disease caused by PEDV (anorexia, weight loss, dehydration, fever, diarrhea, vomiting, poor lactational performance, poor reproduction performance); (2) vaccination of pregnant sows and gilts for protection, prevention, aid in prevention, or aid in control against disease and mortality caused by PEDV in piglets; (3) vaccination of swine 1 day of age or older for protection, prevention, aid in prevention, or aid in control against disease caused by PEDV; (4) booster vaccinations to be administered to sows prior to subsequent farrowings or annually; (5) that healthy swine may be vaccinated with the PEDV MLV and then boostered with PEDV inactivated vaccine; and (6) generally for the protection of swine against weight loss or failure to gain weight caused by PEDV, all and the like.

Attenuation of Prototype Strain USA/IN19338/2013

Since its emergence in the U.S. in April 2013, porcine epidemic diarrhea virus (PEDV) has spread rapidly across the country and resulted in the estimated death of 8 million pigs in the first year, causing economic losses of $900 million to $1.8 billion [1]. In addition, PEDV has recently emerged or re-emerged in a number of countries including China, Japan, South Korea, Philippines, Thailand, Vietnam, Canada, Mexico, Germany, Belgium, France and Portugal [2-10]. So PEDV still remains a significant challenge to the global swine industries. Currently in U.S., there are two commercial PEDV vaccines (a killed vaccine and a RNA particle vaccine). However, some studies showed that these PEDV vaccines induced good IgG and IgA immune responses in herds previously exposed to PEDV but did not induce good IgA response in naïve pigs after vaccination [11-12]. Modified live virus (MLV) PEDV vaccine is more efficacious than the killed or subunit vaccines for inducing mucosal immunity. However, such a safe and efficacious MLV PEDV vaccine against the emerging U.S. strains does not exist currently. The objectives of this study were to characterize the genomic and pathogenic changes of a U.S. virulent PEDV prototype isolate after serial passages in cell culture and determine if any resultant viruses could be potential MLV vaccine candidate against PED.

Materials and Methods

A U.S. PEDV prototype strain cell culture isolate USA/IN19338/2013, previously isolated in our laboratory [13], was serially passed in Vero cells for 100 passages. Pathogenic changes of selected viruses were evaluated in a neonatal pig model. Sixty piglets (5-day-old), free of PED virus and antibody, were randomly divided into 6 groups with 10 pigs per group. Pigs were fed with milk replacer. Groups 1 through 5 (G1-5) were orally inoculated with PEDV USA/IN19338/2013 at the passages 7 (SEQ ID NO:59), 25 (SEQ ID NO:71), 50 (SEQ ID NO:72), 75 (SEQ ID NO:74) and 100 (SEQ ID NO:75), respectively ($10^4$ TCID50/ml, 10 ml/pig) and Group 6 (G6) received the same volume of virus-free culture media as negative control (Table 6). Clinical observations were recorded. Rectal swabs were collected at arrival and daily and tested by a PEDV nucleocapsid gene-based quantitative real-time RT-PCR14. Five pigs from each group were necropsied at 3 and 7 days post inoculation (DPI), respectively. Gross and microscopic lesions of small intestine, cecum and colon were examined and immunohistochemistry (IHC) staining was performed. Microscopic lesion severity was categorized as: 0=no lesion, 1=minimum villous atrophy, 2=mild villous atrophy, 3=moderate villous atrophy and 4=severe villous atrophy. IHC staining was scored as: 0=no signal, 1=minimal staining, 2=mild staining, 3=moderate staining and 4=severe staining. Whole genome sequences of the viruses in original tissue homogenate as well as at the passages P3, P7, P9, P25, P50, P65, P75 and P100 were determined using next-generation sequencing technology [13].

TABLE 6

Animal study design. Experimental infection of 5-day old piglets with PEDV USA/IN19338/2013 at different cell culture passages.

| Group | Virus Passage | Inoculum | Necropsy (3 DPI) | Necropsy (7 DPI) |
|---|---|---|---|---|
| G1 (n = 10) | PEDV P7 | $10^5$ $TCID_{50}$/pig | n = 5 | n = 5 |
| G2 (n = 10) | PEDV P25 | $10^5$ $TCID_{50}$/pig | n = 5 | n = 5 |
| G3 (n = 10) | PEDV P50 | $10^5$ $TCID_{50}$/pig | n = 5 | n = 5 |
| G4 (n = 10) | PEDV P75 | $10^5$ $TCID_{50}$/pig | n = 5 | n = 5 |

TABLE 6-continued

Animal study design. Experimental infection of 5-day old piglets with PEDV USA/IN19338/2013 at different cell culture passages.

| Group | Virus Passage | Inoculum | Necropsy (3 DPI) | Necropsy (7 DPI) |
|---|---|---|---|---|
| G5 (n = 10) | PEDV P100 | $10^5$ TCID$_{50}$/pig | n = 5 | n = 5 |
| G6 (n = 10) | Virus-negative culture medium | Culture medium | n = 5 | n = 5 |

DPI: Days Post Inoculation.

RESULTS AND DISCUSSION

Over serial passaging, viruses became more adapted to cell culture. The higher passages of PEDV USA/IN19338/2013 at P50, P75 and P100 grew more efficiently and achieved higher infectious titers (FIG. 17).

The negative control piglets remained negative throughout the study period. Piglets inoculated with P7, P25, P50, P75, or P100 virus all had watery diarrhea at 1-4 DPI and mild to moderate diarrhea at 5-7 DPI. Piglets inoculated with P7, P25, P50, P75, or P100 virus all shed virus in rectal swabs with a trend that piglets inoculated with higher passage virus shed lower amount of viruses (FIG. 18). Specifically, virus shedding levels were: P7>P25>P50, P75, P100>Neg Ctrl (> means significantly higher; but no significant differences among P50, P75 and P100 groups). There was a trend that piglets inoculated with lower passage virus had more severe villous atrophy. As shown in FIG. 19, at 3 DPI, severity of microscopic lesions was P7, P25>P50, P75, P100, Neg Ctrl in duodenum; P7, P25, P50>P75, P100>Neg Ctrl in jejunum; and P7, P25, P50>P75, P100, Neg Ctrl in ileum. The villus-height-to-crypt-depth ratios were: P7, P25, P50<P75, P100<Neg Ctrl in jejunum and P7, P25, P50<P75, P100, Neg Ctrl in ileum at 3 DPI (FIG. 20). At 3 DPI, the IHC staining in jejunum was: P7, P25, P50, P75>P100>Neg Ctrl; the IHC staining in ileum was: P7, P25, P50>P75, P100, Neg Ctrl; there were no significant differences of IHC scores between various viruses in cecum or colon (FIG. 21). Differences between groups at 7 DPI were not very apparent.

Whole genome sequences were not only determined for viruses at the passages P7, P25, P50, P75, P100 but also determined for the virus present in the original tissue homogenate as well as at the passages P3, P9 and P65. As shown in FIG. 16, comparisons of the whole genome sequences revealed that nucleotide and deduced amino acid changes during serial passages up to P100 are mainly located in replicase non-structural protein (nsp) 2, nsp3, nsp4, nsp5, nsp6, nsp15, spike (S), ORF3, envelope (E), membrane (M), and nucleocaspid (N) proteins. It is notable that starting from the P25, a point mutation at 24908A>T occurred in ORF3 which resulted in a truncated ORF3 protein due to early stop codon of deduced amino acid translation; this point mutation was carried over to the virus at P100. Taken into consideration of both sequence changes and virus virulence changes during serial passages, amino acid changes at 15 positions may potentially be associated with virus attenuation during serial passages in cell culture. These 15 positions include: ppla protein 1564Ser>Phe, 1896Thr>Ile, 2600Asn>Tyr, 3247Leu>Phe, and 3473Ala>Val; S protein 326Thr>Ile, 491Asn>Tyr, 888Gly>Arg, 1277Leu>Phe, 1399Ile>Thr, and 1358Cys>Leu; truncated ORF3 translation; E protein 69Leu>Ile; M protein 208Ala>Thr; and N protein 439Thr>Ile.

In summary, the virulent U.S. PEDV prototype isolate USA/IN19338/2013 clearly became less pathogenic during serial passages in cell culture. Clinical observations, virus shedding in rectal swabs, histopathologic lesions, and IHC staining data suggest that the P75 and P100 viruses have been more attenuated than the P7, P25 and P50 viruses. However, the P75 and P100 viruses still can cause diarrhea and may not have been attenuated enough to be an MLV vaccine candidate. Continuous passage of the virus in cell culture is needed to obtain a fully attenuated vaccine candidate virus. Sixteen amino acid changes appear to be associated with virus attenuation under the conditions of this study. This study provides a strong basis for developing a MLV PEDV vaccine and for understanding the molecular mechanism of virus attenuation.

Those skilled in the art will immediately recognize that although variation exists in nucleotide and amino acid sequences among different isolates, and that deletions and insertions may appear, nonetheless, sequence alignment techniques are well known so that any amino acid position in a PEDV protein can be mapped to the appropriate amino acid position in other isolates. Preferred algorithms and alignment programs for this purpose include ClustalX version 2.0 (Larkin et al, Bioinformatics 23, 2947-2948 (2007)), BioEdit version 7.0.4.1 (Hall, Nucl Acids Symp Ser 41, 95-98 (1999)), and Lasergene software suite (DNAS-TAR Inc, Madison Wis.), which includes the Clustal W algorithm for multiple sequence alignment to align sequences and compare sequence similarity and differences.

FIG. 16 shows that the following amino acid changes are among those preferred for generating properly attenuated PEDV isolates, which provide for vaccine efficacy while exhibiting substantial safety: from ORF1 a and b, amino acid positions 814 (Val), 1076 (Val), 1564 (Phe), 1896 (Ilu), 2310 (His), 2600 (Tyr), 3247 (Phe), 3473 (Val), 3522 (Arg); from the Spike gene, amino acid positions 257 (Asn), 326 (Ile), 375 (Phe), 491 (Tyr), 881 (Arg), 888 (Arg), 1277 (Phe), 1339 (Thr), 1358 (Leu); from ORF3, corresponding to amino acid position 39 or thereafter, any nucleotide change that provided a stop codon; from genome region E, 69 (Ile) for the encoded envelope protein; for genome region M, 208 (Thr) for the encoded membrane protein; and for genome region N, 141 (Leu), 418 (Glu), 424 (Asp) and 439 (Ile) for the encoded nucleocapsid protein. In addition to these changes, which can be used alone or in combination, those skilled in the art will recognize that equivalent amino acid changes are generally available, for example that positively charged residues can be substituted for positively charged residues (Arg, Lys, His), that negatively charged residues can be substituted for negatively charged residues (Glu, Asp), or that equivalent substitutions can be made based on polarity or functional group (such as Thr for Ser and vice versa; Try for Trp and vice versa; Ileu, Val, Leu, all for each other, all and the like).

REFRENCES

1. Paarlberg, P. L. 2014. Updated estimated economic welfare impacts of porcine epidemic diarrhea virus (PEDV). http://ageconsearch.umn.edu/bitstream/174517/2/14-4. Updated %20Estimated %20Economic %20Welfare %20Impacts %20of %20PEDV.pdf.
2. Grasland, B., Bigault, L., Bernard, C., Quenault, H., Toulouse, O., Fablet, C., Rose, N., Touzain, F. and Blanchard, Y., 2015. Complete genome sequence of a porcine epidemic diarrhea s gene indel strain isolated in france in december 2014. Genome Announc 3.

3. Mesquita, J. R., Hakze-van der Honing, R., Almeida, A., Lourenco, M., van der Poel, W. H. and Nascimento, M. S., 2015. Outbreak of Porcine Epidemic Diarrhea Virus in Portugal, 2015. Transbound Emerg Dis 62, 586-8
4. Pasick, J., Berhane, Y., Ojkic, D., Maxie, G., Embury-Hyatt, C., Swekla, K., Handel, K., Fairles, J. and Alexandersen, S., 2014. Investigation into the role of potentially contaminated feed as a source of the first-detected outbreaks of porcine epidemic diarrhea in Canada. Transbound Emerg Dis 61, 397-410.
5. Puranaveja, S., Poolperm, P., Lertwatcharasarakul, P., Kesdaengsakonwut, S., Boonsoongnern, A., Urairong, K., Kitikoon, P., Choojai, P., Kedkovid, R., Teankum, K. and Thanawongnuwech, R., 2009. Chinese-like strain of porcine epidemic diarrhea virus, Thailand. Emerg Infect Dis 15, 1112-5.
6. Song, D. and Park, B., 2012. Porcine epidemic diarrhoea virus: a comprehensive review of molecular epidemiology, diagnosis, and vaccines. Virus Genes 44, 167-75.
7. Vui, D. T., Thanh, T. L., Tung, N., Srijangwad, A., Tripipat, T., Chuanasa, T. and Nilubol, D., 2015. Complete genome characterization of porcine epidemic diarrhea virus in Vietnam. Arch Virol 160, 1931-8.
8. Stadler, J., Zoels, S., Fux, R., Hanke, D., Pohlmann, A., Blome, S., Weissenbock, H., Weissenbacher-Lang, C., Ritzmann, M. and Ladinig, A., 2015. Emergence of porcine epidemic diarrhea virus in southern Germany. BMC Vet Res 11, 142.
9. Theuns, S., Conceicao-Neto, N., Christiaens, I., Zeller, M., Desmarets, L. M., Roukaerts, I. D., Acar, D. D., Heylen, E., Matthijnssens, J. and Nauwynck, H. J., 2015. Complete genome sequence of a porcine epidemic diarrhea virus from a novel outbreak in belgium, january 2015. Genome Announc 3.
10. Vlasova, A. N., Marthaler, D., Wang, Q., Culhane, M. R., Rossow, K. D., Rovira, A., Collins, J. and Saif, L. J., 2014. Distinct Characteristics and Complex Evolution of PEDV Strains, North America, May 2013-February 2014. Emerg Infect Dis 20, 1620-1628.
11. Thomas, P. (2014). Field experiences using porcine epidemic diarrhea virus (PEDV) vaccine in herds experiencing endemic disease. In "2014 Iowa State University Swine Disease Conferencee for Swine Practitioners", pp. 38-42, Ames, Iowa.
12. Schwartz, T. J. and Rademacher, C. J. (2015). Evaluation of the effects of PEDv vaccine on PEDv naïve and previously PEDv-exposed sows in a challenge model comparing immune response and preweaning mortality. In "2015 ISU James D. McKean Swine Disease Conferencee", pp. 36-40, Ames, Iowa.
13. Chen, Q., Li, G., Stasko, J., Thomas, J. T., Stensland, W. R., Pillatzki, A. E., Gauger, P. C., Schwartz, K. J., Madson, D., Yoon, K. J., Stevenson, G. W., Burrough, E. R., Harmon, K. M., Main, R. G. and Zhang, J., 2014. Isolation and characterization of porcine epidemic diarrhea viruses associated with the 2013 disease outbreak among swine in the United States. J Clin Microbiol 52, 234-43.
14. Thomas, J. T., Chen, Q., Gauger, P. C., Gimenez-Lirola, L. G., Sinha, A., Harmon, K. M., Madson, D. M., Burrough, E. R., Magstadt, D. R., Salzbrenner, H. M., Welch, M. W., Yoon, K. J., Zimmerman, J. J. and Zhang, J., 2015. Effect of Porcine Epidemic Diarrhea Virus Infectious Doses on Infection Outcomes in Naive Conventional Neonatal and Weaned Pigs. PLoS One 10, e0139266.

Attenuation of U.S. S-INDEL-Variant Strain USA/IL20697/2014 (2014020697)

FIG. 24 and Tables 1 and 2, provide certain information concerning amino acid changes that correspond to attenuates of a variant strain USA/IL20697/2014. The variant isolate USA/IL20697/2014 was serially passed in cell culture in two independent lineages.

In the first lineage, the virus was passed in cell culture up to $60^{th}$ passage (P60); the viruses at different passages were named as 2014020697-P1, 2014020697-P2, 2014020697-P3 . . . 2014020697-P60. Among them, whole genome sequences of the viruses 2014020697-P3 (SEQ ID NO:63), 2014020697-P5 (SEQ ID NO:8), 2014020697-P7 (SEQ ID NO:62), 2014020697-P18 (SEQ ID NO:64), 2014020697-P30 (SEQ ID NO:65), 2014020697-P45 (SEQ ID NO:39), and 2014020697-P60 (SEQ ID NO:66) were determined and compared.

In the second lineage, the virus was serially passed in cell culture and the viruses at some passages were also plaque (colony) purified. Among them, whole genome sequences were determined and compared for the viruses 2014020697-P3R1 (SEQ ID NO:67), 2014020697-P5R1 (SEQ ID NO:68), 2014020697-P7R1 (SEQ ID NO:15), 2014020697-P8R1 (SEQ ID NO:35), 2014020697-P18R1 clone 89G8b (SEQ ID NO:36), 2014020697-P18R1 clone 94F6a (SEQ ID NO:37), and 2014020697-P18R1 clone 92F6a (SEQ ID NO:37) (it should be noted that P18R1 94F6a and P18R1 92F6a (SEQ ID NO:37) are duplicates of the same clone run for verification purposes, see Tables 1 and 2). Additionally, passaging of 2014020697-P18R1 G8b and 2014020697-P18R1 F6a into subsequent passages 19 and 20 retained genetic identity to their respective clones at passage 18R1. The resultant viruses provide both needed clinical safety, according to all recognized trial endpoints, and remain both highly protecting as to challenge by similar variant (INDEL) strains, and cross protective as to highly pathologic prototype strains.

Referring to the "Amino Acid Changes" section of FIG. 24 and Table 2, it can be seen that ORF1a/1b at encoded amino acid position 551 provides leucine. In fact, leucine appears to be almost invariant in PEDV isolates (whether prototype or variant-INDEL) at this position, in that leucine was found to represent residue 551 in approximately 500 randomly selected compared published sequences. Although clinical data for 2014020697-P18R1 F6a (SEQ ID NO:37), and 2014020697-P18R1 G8b (SEQ ID NO:36), both show remarkable levels of safety and efficacy, it is noted that the 2014020697-P18R1 F6a does provide a further enhancement in both safety and efficacy, making it a highly commercializable material. 2014020697-P18R1 F6a provides proline at position 551, an amino acid well known to disrupt or define boundaries between peptide secondary structural domain types, and thus the contribution of Pro 551 to the final phenotype would be expected. Given the invariant use of Leu at this position in PEDV genomes, it is a further embodiment of the present invention to insert a Pro residue at position 551, or immediately adjacent thereto (such was within about 2-3 amino acid residues thereof, upstream or downstream. Modeling using well known algorithms (see P. Y. Chou et al., "Prediction of Protein Conformation", Biochemistry, 13(2), pp 222-245, 1974; J. Garnier et al., J. Mol. Biol., v 120. pp. 97-120, 1978; and J. Garnier et al., Methods Enzymology, v 266, pp. 540-543, 1996) predicts an alpha helical domain at least involving residues DEDAT immediately upstream from the 551 position L, wherein L falls at (but still contributes to) the approximate C-terminal end of this secondary domain structural feature. Insertion of proline substantially disrupts this alpha helical feature. It is also within the practice of the invention to insert a glycine residue as amino acid 551 for ORF1a/b, again with the expectation of a resultant highly attenuated yet safe vaccine, and the glycine residue may be similarly located within about 2-3 amino acid residues of position 551, upstream or downstream. All such substitutions are applicable to all PEDV clones, whether prototype or variant (INDEL).

Turning now to the amino acid changes reflected in both 2014020697-P18R1 G8b and 2014020697-P18R1 F6a at position 973 in the spike protein, it can be seen that the wild type amino acid tyrosine has been replaced by histidine, which substantially contributes to the valuable phenotype of these clones. It is therefore an embodiment of the invention to provide histidine at this locus generally, in all genomes of PEDV, which are being modified or selected for to provide safe and efficacious vaccines, whether from prototype or variant (INDEL) strains.

Turning further to an important amino acid change reflected in both 2014020697-P18R1 G8b and 2014020697-P18R1 F6a at position 1009 in the spike protein (i.e. immediately after NIT in SEQ ID NO:47), it can be seen that the wild type amino acid serine has been replaced by proline. This mutation appeared during an earlier attenuating passage, between 2014020697-P5R1 (SEQ ID NO:68) and 2014020697-P7R1 (SEQ ID NO:15). As is similarly the case for the leucine to proline mutation noted above in regard of ORF1a/1b position 551, the appearance of proline is highly disruptive of secondary and tertiary protein structure, and substantially contributes to the attenuated properties of the present vaccine strains. It is again within the practice of the invention to provide a proline residue at position 1009, or the corresponding position in the spike protein of any PEDV vaccine virus. Glycine may also be substituted for proline at this position in any PEDV strain, in order to improve vaccine safety. It is therefore an embodiment of the invention to provide proline or glycine at this locus generally, in all genomes of PEDV, which are being modified or selected for to provide safe and efficacious vaccines, whether from prototype or variant (INDEL) strains. It should also be noted that the proline/glycine replacement can also be made immediately adjacent to position 1009, such as within about 2-3 amino acid residues thereof, upstream or downstream.

An additional feature of many of the viruses of the invention that are useful as vaccines (including the G8b and F6a Passage 18R1 clones, SEQ ID NOS:36 and 37, and the separate lineage virus represented by Passage 38, SEQ ID NO: 78, for example), is the expression therein of only a truncated ORF3 protein, typically caused by a frameshift mutation in the ORF3 reading frame (see Table 2) and therefore the appearance of a stop codon, or alternatively, the appearance of other features (such as a deleted amino acid, again see Table 2) resulting in a partially or wholly inoperative ORF3 protein. We have observed that deletions and/or frameshifts in ORF3 protein appear to be associated with adaptation to tissue culture conditions, and therefore it is likely that ORF3 is necessary for overcoming host immune defense, becoming unnecessary under in vitro culture conditions. As such, ORF3 deletions are important for vaccine viruses, contributing to their safety for use in swine. Referring to the truncated ORF3 protein expressed from 2014020697-P18R1 G8b and 2014020697-P18R1 F6a (SEQ ID NO:31), it is noted (Table 2) that this mutation has already been successfully achieved by passage P8R1 (see SEQ ID NO:18), with the resultant protein sequence being:

MFLGLFQYTIDTVVKDVSKSANLSLDAVQELELNVVPIRQASNVTGFLFT
SVFIYFFALFKASSLRRNYIMLAARFAVIVLYCPLLYYCGAFLDATIICC
TLIGRLCLVCFYSWRYKNALFIIFNTTTLSFLNGKAALTANPL

It is thus within the practice of the invention to provide vaccine viruses containing any truncation of the ORF3 reading frame, suitable to limit ORF3 function, such as those already discussed above in relation to vaccine virus 2014020697-P38 (SEQ ID NO:78) and the earlier passages thereof (see again Table 2), or those associated with virus sequences SEQ ID NO: 36 and 37. Those skilled in the art are readily able to provide a truncation of any ORF3 protein of any prototype strain or variant INDEL strain, to containing corresponding truncations, referencing direct comparison of sequences and algorithms for aligning sequences. Thus, vaccine viruses of the invention include those having SEQ ID NO:18 as resultant ORF3 protein, or any fragment thereof (10, 20, 30, 40, 50, 60 amino acid residues, and the like), or any fragment of full length ORF3 protein that is less able to inhibit host immune function.

These mutations substantially contribute to the final clinically effective phenotype of the vaccine attenuates of the present invention, and as aforementioned, referencing commonplace alignment programs and algorithms, are readily copied into the amino acid sequence of corresponding proteins in all prototype and variant (INDEL) strains. Conservative amino acid replacements, instead of the specifically named residue changes, are also appropriate in all cases, and all amino acid changes (and conservative substitutions thereof) observed for any of the prototype and variant (INDEL) viruses of the invention may be usefully placed in any PEDV virus (whether prototype or INDEL) for the purposes of improving the usefulness of any such resultant virus as a vaccine.

Further information on passaging herein is as follows. Subsequent passaging (8 to 19) was performed from 2014020697-P7R1 (SEQ ID NO: 15) material. 2014020697-P8R1 consensus sequence did not show any changes at the amino acid level compared to 2014020697-P7R1. 2014020697-P8R1 was then further passaged to 2014020697-P11R1, with clonal selection at each step between subsequent passages 11 through 14, followed by subsequent passaging to 2014020697-P18R1 with collection of substantial material in order to run clinical trials. The open reading frame amino acid sequences for 2014020697-P18R1 G8b and 2014020697-P18R1 F6a are shown as FIGS. 22B (SEQ ID NOS: 23-28) and 22C (SEQ ID NOS: 29-34), respectively, and the corresponding nucleotide sequences, full length, for 2014020697-P18R1 G8b and 201402697-P18R1 F6a are shown as FIGS. 23B (SEQ ID NO: 36) and 23C (SEQ ID NO: 37) respectively. Significant and successful clinical results are reported for 2014020697-P18R1 F6a. In this regard, see Examples 5 and 6, which shows the remarkable safety and cross protecting efficacy of these vaccine materials.

It should also be noted that "passage 7" 2014020697-P7, lineage 1 (SEQ ID NO:62) and "passage 60" 2014020697-P60 passage 60, lineage 1 (SEQ ID NO:39) amino acid sequence mutational information is also reported in FIG. 24 and Table 2, and mutations responsible for the safety and efficacy of this material are disclosed therein. That the material is also an excellent candidate for a safe and efficacious cross-protecting vaccine is also apparent from the clinical data reported in Examples 5 and 6, for 2014020697-P38 (SEQ ID NO:78), a precursor to 2014020697-P60 and also the clinical data and discussion from Example 2 comparing mutations within 2014020697-P7 variant strain leading to attenuation.

Example 5

(Two Dose Study) Safety and Cross-Protection of PEDV INDEL Virus Administered Orally at Approximately 1 and 21 Days of Age Followed by a Virulent PEDV Challenge The objective of the study was to determine the safety and cross protection of specific attenuate passages of PEDV isolates derived from the variant (INDEL) strain of PED, USA/IL/2014-20697, when administered orally to piglets at 3 (+/−2) days of age (Day 0) and Day 21 followed by a virulent PEDv challenge at Day 35 (+/−2). Safety was determined by the incidence of mortality and clinical signs related to PEDv post inoculation at Day 0 and 21. Indication of cross-protection was determined by the incidence of mortality and clinical signs related to virulent PEDv post challenge. The tested viruses are those encoded from DNA sequences: (a) SEQ ID NO:36 (designated Clone G6b, which remains unchanged between passages 18 and 19 thereof); (b) SEQ ID NO:37 (designated Clone F6, which remains unchanged between passages 18 and 19 thereof); and (c) from a different set of passages from the USA/IL/2014-2069 ancestor, Passage 38 (SEQ ID NO:78) thereof. It should be noted that SEQ ID NOS 36 and 37 differ from each other only in that encoded amino acid position 551 of polyprotein 1a/1b, is either L or P at position 551 (see immediately after DAT in SEQ ID NO:46).

Vaccination doses (control was media only) of the live attenuates are 1×10⁴ TCID50 using 2 ML per oral doses. "TCID50" refers to "tissue culture infective dose" and is defined as that dilution of a virus required to infect 50% of a given batch of inoculated cell cultures. Various methods may be used to calculate TCID50, including the Spearman-Karber method which is utilized throughout this specification. For a description of the Spearman-Karber method, see B. W. Mahy & H. O. Kangro, Virology Methods Manual, p. 25-46 (1996).

The actual challenge material (having a concentration of 1×10⁵ TCID50/5 ML dose) is closely related to USA/Colorado/2013, GenBank Accession No. KF272920, being specifically a contemporary North American epidemic isolate from the University of Minnesota Veterinary Diagnostic Laboratory, Accession D13-031630, from a farm in Iowa, live material. The sample is negative for rotavirus A, B, and C, TGE, *Clostridium difficile* toxin and *Clostridium perfringens*.

PCR assessment of fecal shedding was performed by RTqPCR analysis wherein a reported value of 35 is negative (equal to a control) and values less than 35 are positive for shed virus. The number reported is the number of cycles used for detection, with 35 being the maximum at which non-detection is declared. Protocol followed is generally as otherwise recited in the specification, and is similarly achieved as follows. Fecal swabs are collected in 3 milliliters of DMEM media and stored at −80° C. until use. Samples are thawed at 4° C. and mixed by vortexing for 5 seconds. One milliliter of sample is removed from tube and placed in a 96-well block and centrifuged at 3200 rpm for 10 minutes to sediment fecal particulate material. Two hundred microliters of fecal sample supernatant are used for nucleic acid extraction using the Qiagen DSP Virus/Pathogen Mini Kit on the Qiagen QIAsymphony Automated Robot or the Qiagen cador Pathogen 96 Kit on the QIA cube HT machine following manufactures instructions. Cycle threshold values were determined by RT-QPCR analysis using the Path-ID Multiplex One-Step RT-PCR kit (Applied Biosystems/Life Technologies) and PEDV N-gene primers and probe. PEDV Forward Primer: PEDV N gene-F 5'-GAATTCCCAA GGGCGAAAAT-3' @ [100 uM], Reverse Primer: PEDV N gene-R 5'-TTTTCGACAAATTCCGCATCT-3'@ [100 uM], PEDV Probe 6FAM 5'-CGTAGCAGCTTGCTTCG GAC CCA 3' TAMRA. A standard curve is generated with the PEDV N-gene PCR amplicon and Ct values are used to determine a copy number value for each sample based on the standard curve. Values reported in parenthesis show the number of piglets in each group that are positive for virus as numerator, with the denominator showing the total number of piglets remaining in that particular group (not yet sacrificed for necropsy) on the days indicated. Results are as follows:

It was noted (Table 7) that the Passage 38 material contributed to a small amount of early mortality, not subsequently apparent, although subsequent Passage 60 thereof (SEQ ID NO:66) was created to alleviate this circumstance.

Referring to Table 8, fecal shedding was measured via PCR. Referencing the "35" control value (no shedding), it can be seen that all clones protected the piglets compared to a challenged control that received only media as vaccination. It should be noted that protection was greater for Clone F6a than for clone G8b, consistent with the completely unique proline residue present in this clone (position 551 for Orf1a/b protein).

Similarly, as shown in Table 9 (again compared to non vaccinated control), following challenge, all 3 viral isolates substantially prevented shedding shedding, with the F6a clone again showing better results than clone G8b.

TABLE 7

Cumulative Mortality by Time-point (animal deaths/percent of total)

| TX | N | D1 | D4 | D6 | Total |
|---|---|---|---|---|---|
| Media | 30 | 0 | 0 | 0 | 0 (0.0) |
| PED + 19 F6a | 29 | 0 | 0 | 0 | 0 (0.0) |
| PED + 19 G8b | 28 | 0 | 0 | 0 | 0 (0.0) |
| PED + 38 | 30 | 0 | 1 (3.3) | 2 (6.7) | 2 (6.7) |

TABLE 8

Fecal Shed in Piglets Post Challenge (RTqPCR (# pigs positive/total pigs))

| TX | D 36 | D 37 | D 39 | D 42 | D 45 | D 47 | D 49 | D 52 | D 55 |
|---|---|---|---|---|---|---|---|---|---|
| Media | 35 | 35 (2/18) | 27 (13/18) | 25 (8/10) | 29 (7/10) | 32 (3/10) | 31 (5/10) | 31 (5/10) | 33 (3/10) |
| PED + 19 F6a | 35 | 35 | 35 | 35 | 35 | 35 | 35 | 35 | 35 |
| PED + 19 G8b | 35 | 35 | 33 (2/17) | 34 (2/8) | 25 (4/8) | 24 (7/8) | 26 (6/8) | 34 (2/8) | 35 (1/8) |
| PED + 38 | 35 | 35 | 35 | 35 | 35 | 35 | 35 | 35 | 35 |

TABLE 9

| | Duration of Shedding Post-Challenge (mean days positive (range)) | | |
|---|---|---|---|
| TX | 1st Inoculation | 2nd Inoculation | Challenge Phase |
| Media | 0.1 (0-2.0) | 0.0 | 7.0 (0-17.0) |
| PED + 19 F6a | 12.9 (7.0-16.0) | 4.4 (0-14.0) | 0.0 |
| PED + 19 G8b | 11.7 (0-16.0) | 3.4 (0-14.0) | 4.8 (0-17.0) |
| PED + 38 | 11.5 (2.0-16.0) | 3.1 (0-13.5) | 0.0 |

Example 6

Single Dose Efficacy and Safety in Day Old Piglets

The attenuated PEDV viruses corresponding to (encoded from) SEQ ID NO: 36 (Clone G8b) and SEQ ID NO: 37 (clone F6a) show remarkable efficacy as vaccines, providing cross protection against later challenge with virulent North American prototype virus (represented by USA/Colorado/2013, GenBank Accession No. KF272920, for example). Such protection is achieved with only a single dose of vaccine, provided to piglets as early as at Day 1 of life, even when the mother sow is PEDV-naïve, i.e. seronegative, having been neither exposed to wild virus, nor having ever been vaccinated. This level of efficacy accords great flexibility to producers in terms of how swine operations are managed, when sows and piglets are vaccinated, and also accords to producers the capacity to vaccinate sow herds or piglets without conducting assays to determine the sero-status of any animals prior to vaccination. These results are important given that the pathology of PEDV infection is most serious in piglets at birth, and decreases (as does the need or value) of vaccination with age of the animals. It should be noted that the vaccines incorporating the SEQ ID NO:36 and 37 viruses are useful irrespective of whether the mother sow is seropositive or seronegative prior to birth of the piglet, and that colostrum derived maternal antibody does not prevent the present vaccines from being effective, irrespective of whether the mother sow was previously infected with a wild strain, a vaccine strain (including being infected thereby from the piglet), or was vaccinated with a live or killed vaccine, in either case one or more times, including pre-breeding and pre-farrowing. A second dose to the piglet can also be given, if desired by the producer.

Accordingly, representative examples of vaccination programs useful in the practice of the invention include: a method of treating or preventing disease in a piglet caused by PEDV, comprising administering to said piglet a first dose of the vaccine composition when said piglet is about 1-7 days old, further or optionally, administering a second dose of said vaccine when the piglet is about 2-5 weeks old. Irrespective of whether 1 or 2 doses is administered to the piglet, the parent sow can be vaccinated pre-breeding or pre-farrowing in the alternative, or at both said time points, irrespective or whether the mother sow was already seropositive (such was from previous infection). As aforementioned, alternatively, the mother sow is seronegative, The objective of the present study was thus to determine the safety and cross protection of two passaged PEDV isolates (SEQ ID NOS: 36 and 37) derived from the variant (INDEL) strain of PED, USA/IL/2014-20697, when administered orally to piglets at 1 days of age (Day 0) followed by a virulent PEDv challenge at Day 21 (22 days of age). Safety will be determined by the incidence of mortality and clinical signs related to PEDv post inoculation. Indication of cross-protection was determined by the incidence of mortality and clinical signs and intestinal lesions related to virulent PEDv post challenge.

Vaccination doses (control was media only) are $1\times10^4$ $TCID^{50}$ using 2 ML per oral doses. "TCID50" refers to "tissue culture infective dose" and is defined as that dilution of a virus required to infect 50% of a given batch of inoculated cell cultures. Various methods may be used to calculate TCID50, including the Spearman-Karber method which is utilized throughout this specification. For a description of the Spearman-Karber method, see B. W. Mahy & H. O. Kangro, Virology Methods Manual, p. 25-46 (1996).

Piglets within each group were further assigned to one of three outcomes, sacrificed for necropsy on Day 6, sacrificed for necropsy on Day 28, or the piglets complete the study and are reported out to Day 40.

The actual challenge material (having a concentration of $1\times10^5$ $TCID_{50}$/5 ML dose) is closely related to USA/Colorado/2013, GenBank Accession No. KF272920, being specifically a contemporary North American epidemic isolate from the University of Minnesota Veterinary Diagnostic Laboratory, Accession D13-031630, from a farm in Iowa. The sample is negative for rotavirus A, B, and C, TGE, *Clostridium difficile* toxin and *Clostridium perfringens*.

Representative results are provided by fecal shedding scores, in the Table below. Dates below are calculated from Day 0 (i.e. 1 day of age, the date of vaccination with G8b or F6a attenuated virus).

TABLE 10

| | Fecal Shed in Piglets Post Virulent Challenge [RTqPCR (# pigs positive/total pigs)] | | | | | |
|---|---|---|---|---|---|---|
| Vaccine Group | Day 25 | Day 27 | Day 30 | Day 33 | Day 37 | Day 40 |
| T01 - Media only | 40 | 28 (14/19) | 31 (7/9) | 34 (6/9) | 37 (4/9) | 39 (1/9) |
| T02 - PEDV G8b | 40 | 39 (1/18) | 40 | 40 | 40 | 40 |
| T03 - PEDV F6a | 40 | 39 (1/21) | 40 | 40 | 40 | 40 |

PCR assessment of fecal shedding was performed by RTqPCR analysis wherein a reported value of 40 is negative (equal to a control) and values less than 40 are positive for shed virus. The number reported is the number of cycles used for detection, with 40 being the maximum at which non-detection is declared. Protocol followed is generally as otherwise recited in the specification, and is similarly achieved as follows. Fecal swabs are collected in 3 milliliters of DMEM media and stored at −80° C. until use. Samples are thawed at 4° C. and mixed by vortexing for 5 seconds. One milliliter of sample is removed from tube and placed in a 96-well block and centrifuged at 3200 rpm for 10 minutes to sediment fecal particulate material. Two hundred microliters of fecal sample supernatant are used for nucleic acid extraction using the Qiagen DSP Virus/Pathogen Mini Kit on the Qiagen QIAsymphony Automated Robot or the Qiagen cador Pathogen 96 Kit on the QIA cube HT machine following manufactures instructions. Cycle threshold values were determined by RT-QPCR analysis using the Path-ID Multiplex One-Step RT-PCR kit (Applied Biosystems/Life Technologies) and PEDV N-gene primers and probe. PEDV Forward Primer: PEDV N gene-F 5'-GAATTCC- CAAGGGCGAAAAT-3' @ [100 uM], Reverse Primer: PEDV N gene-R 5'-TTTTCGACAAATTCCGCATCT-3'@ [100 uM], PEDV Probe 6FAM 5'-CGTAGCAGCTT GCTTCGGACCCA 3' TAMRA. A standard curve is generated with the PEDV N-gene PCR amplicon and Ct values are used to determine a copy number value for each sample based on the standard curve. Values reported in parenthesis then show the number of piglets in each group that are positive for virus as numerator, with the denominator showing the total number of piglets remaining in that particular group (not yet sacrificed for necropsy) on the days indicated. Results at Day 27 and Day 30 show that a very high number of challenged (but not vaccinated) controls are shedding virus, whereas piglets vaccinated with attenuates G8b and F6a are remarkably well protected.

USA/IL20697/2014-P7R1 (V-variant strain) at Day 0 (D0) followed by challenge at D28. Inoculation at each point used 10 ml of inoculum per pig, containing 104 TCID50/ml for virus inocula. Seven groups were designated according to 1st inoculation/2nd inoculation: P/V (15 pigs), V/V (15 pigs), N/V (15 pigs), P/P (10 pigs), V/P (10 pigs), N/P (10 pigs), N/N (10 pigs).

TABLE 11

Experimental design.

| Group | Day 0 (3-week-old) (1$^{st}$ Inoculation) | D4 (Necropsy) | D28 (7-week-old) (2$^{nd}$ inoculation) | D34 (Necropsy) | D56 (Necropsy) |
| --- | --- | --- | --- | --- | --- |
| G1 P/V (n = 15) | Prototype PEDV | n = 5 | Variant PEDV | n = 5 | n = 5 |
| G2 V/V (n = 15) | Variant PEDV | n = 5 | Variant PEDV | n = 5 | n = 5 |
| G3 N/V (n = 15) | Neg medium | n = 5 | Variant PEDV | n = 5 | n = 5 |
| G4 P/P (n = 10) | Prototype PEDV | n = 0 | Prototype PEDV | n = 5 | n = 5 |
| G5 V/P (n = 10) | Variant PEDV | n = 0 | Prototype PEDV | n = 5 | n = 5 |
| G6 N/P (n = 10) | Neg medium | n = 0 | Prototype PEDV | n = 5 | n = 5 |
| G7 N/N (n = 10) | Neg medium | n = 0 | Neg medium | n = 5 | n = 5 |

Notes:
P = Prototype PEDV isolate USA/IN19338/2013;
V = Variant PEDV isolate USA/IL20697/2014;
N = Neg culture medium.
Inocula: $10^4$ TCID$_{50}$/ml, 10 ml per pig for either the Prototype or the Variant isolates; or 10 ml culture medium per pig for Neg Control.

Example 7

Introduction

Porcine epidemic diarrhea virus (PEDV) was detected in the United States (U.S.) for the first time in April 2013 [1]. Currently at least two genetically different PEDV strains have been identified and co-circulate in U.S. swine (U.S. PEDV prototype strain and S-INDEL-variant strain) [2-4]. In a previous study, we have experimentally confirmed that the U.S. S-INDEL-variant strain is less pathogenic than the U.S. prototype strain in 5-day-old piglets [5]. However, pathogenicity of PEDV can be age-dependent [6-7]. The objectives of the current study were to 1) evaluate the pathogenesis differences of two U.S. PEDV strains in weaned pigs; and 2) examine the cross-protection efficacy between two strains in weaned pigs.

Materials and Methods

Eighty-five 3-week-old pigs were purchased from a conventional breeding farm and delivered to the Iowa State University Laboratory Animal Resources facilities. All pigs were intramuscularly injected with a dose of Excede® upon arrival and confirmed negative for PEDV, porcine deltacoronavirus, and transmissible gastroenteritis virus by virus-specific PCRs on rectal swabs and negative for PEDV antibody by a virus-specific indirect fluorescent antibody (IFA) assay on serum samples.

Pigs were blocked by weight and then randomly divided into 7 groups with 15 or 10 pigs per group (Table 11). Pigs were orogastrically inoculated with virus-negative culture medium (N), PEDV prototype isolate USA/IN19338/2013-P7 (P-prototype strain), or PEDV S-INDEL-variant isolate At D4, five pigs from the P/V, V/V, and N/V groups were necropsied for comparison of gross and microscopic lesions between the two PEDV strains. Five pigs from all 7 groups were necropsied 6 days after the 2nd inoculation (D34) to evaluate cross-protection efficacy in term of gross and microscopic lesions. The remaining 5 pigs per group were kept until 4 weeks after the 2nd inoculation (D56) to evaluate virus shedding and post-challenge antibody response.

Clinical observations were recorded. Rectal swabs were collected at D0, 2, 4, 7, 10, 14, 21, 28, 30, 32, 34, 38, 42, 49 and 56 and tested by a quantitative PEDV N gene-based real-time RT-PCR. Serum samples were collected at D0, 7, 14, 21, 28, 35, 42, 49 and 56 and tested by indirect fluorescent antibody (IFA) assay and virus neutralization (VN) assay using two PEDV strains as indicator viruses, respectively. Small intestines were collected for histopathology evaluation and immunohistochemistry (IHC) staining.

Generalized linear mixed (GLIMMIX) model was used to analyze virus shedding titer Log 10(gc/ml), IFA and VN Ab titers, clinical observation scores, pathological scores, villus heights to crypt depths (VH/CD) ratio differences among groups using Statistical Analysis System (SAS) version 9.3 (SAS institute, Cary, N.C.). During D0-D28, the N/N, N/V and N/P groups received the same inoculum and were analyzed as the same treatment, similarly for the V/V and V/P groups, and P/V and P/P groups. IFA titers were transferred to log 2([IFA titer]/10), and VN titers were transferred to log 2(VN titer) prior to statistical analysis. P-value <0.05 was defined as statistically significant difference.

Results

Pathogenesis comparison of U.S. PEDV prototype strain and S-INDEL-variant strain in 3-week-old pigs. During D0-D28, 7 groups of pigs were in 3 categories: P-strain inoculation (P/V and P/P groups), V-strain inoculation (VN and V/P groups), and Neg culture medium inoculation (N/V, N/P, and N/N groups).

Following the 1st inoculation (D0) of 3-week-old pigs, the two groups inoculated with the P-strain (P/V and P/P)

developed semi-watery to watery diarrhea between D2 and D4; one group (V/P) inoculated with the V-strain had mild soft feces during D2-D4 and the other group (V/V) inoculated with the V-strain developed watery diarrhea from D5 to D7. For the other 3 groups (N/N, N/V and N/P) inoculated with virus-negative culture medium at the 1st inoculation, no diarrhea was observed up to D28.

As shown in FIG. 28, the Neg control pigs (N/N, N/V and N/P groups) did not shed any virus in rectal swabs during D0-D28 as tested by quantitative PEDV rRT-PCR. Fecal shedding in the P-strain-inoculated groups (P/V and P/P) reached the peak level at D4 and then gradually declined. In contrast, fecal shedding in the V-strain-inoculated groups (V/V and V/P) gradually increased in the first a few days and reached the peak level at D7. Pigs inoculated with the P-strain (P/V and P/P groups) overall shed significantly higher amount of virus in feces than pigs inoculated with the V-strain (V/V and V/P groups) from D0-D28 (P=0.0396).

Five pigs from the P-strain-inoculation (P/V group), V-strain inoculation (V/V group), and Neg medium inoculation (N/V group) were necropsied at D4 (4 days post the 1st inoculation) to compare the macro- and micro-pathological lesions caused by the P-strain and V-strain in 3-week-old pigs. The average content scores of small intestines, ceca, and colons were numerically higher in P-strain-inoculated pigs than V-strain and mock-inoculated pigs but differences were not significant (FIG. 29A). The average gross lesion scores in small intestines and ceca of the V-strain and mock-inoculated pigs were not significantly different, but were both significantly less severe than the P-strain-inoculated pigs (FIG. 29A). The villus-height-to-crypt-depth (VH/CD) ratios in distal jejunums and ileums of P-strain-inoculated pigs were significantly lower than V-strain pigs, suggesting that the villous atrophy caused by the P-strain was more severe than the V-strain (FIG. 30A). Between V-strain groups and mock-inoculated groups, the average VH/CD ratios in distal jejunums and ileums were not significantly different (FIG. 30A).

For IHC staining at D4, P-strain-inoculated pigs had respective average IHC scores of 4 and 4 in distal jejunum and ileum, which were significantly higher than the V-strain-inoculated pigs that had average IHC scores of 1.4 and 1.4 in distal jejunum and ileum, respectively (FIG. 29B). Interestingly, PEDV IHC staining was also observed in cecum epithelia cells of 3 pigs (scores of 1, 1, and 2) and colon epithelia cells of 1 pig (score of 1) inoculated with the P-strain. PEDV IHC staining was not observed in ceca and colons of V-strain-inoculated pigs. PEDV IHC staining was not observed in any tissues (small intestine, cecum, and colon) of mock-inoculated pigs.

Pathogenesis comparison of U.S. PEDV prototype strain and S-INDEL-variant strain in 7-week-old pigs. After the 2nd inoculation at D28 (pigs were 7-week-old at that time), the N/V, N/P and N/N groups were compared to evaluate the pathogenesis of the P-strain and V-strain in 7-week-old weaned pigs.

After the 2nd inoculation, the N/P and N/N group did not have diarrhea while the N/V group developed watery diarrhea during D33-D38 (5-10 days post 2nd inoculation). No any virus was detected from the N/N group in rectal swabs from D28 to D56. The N/V group overall shed significantly higher level of virus in rectal swabs than the N/P group during D28-D56 (P=0.0359) (FIG. 28).

Five pigs necropsied from the N/N, N/V and N/P groups at D34 (6 days post the 2nd inoculation) were compared to evaluate the macro- and micro-pathological lesions caused by the P-strain and V-strain in 7-week-old pigs. Overall the macro-pathological changes were minor in all three groups of pigs. The average content scores of small intestines, ceca, and colons were similar between the P-strain and mock-inoculated pigs but were significantly lower than the V-strain-inoculated pigs (FIG. 29B). The average gross lesion scores in small intestines were not significantly different among the P-strain, V-strain and mock-inoculated pigs (FIG. 29B); but the average gross lesion scores in ceca and colons of the V-strain-inoculated pigs were significantly higher than the P-strain and mock-inoculated pigs (FIG. 29B). At D34, the VH/CD ratios in distal jejunums and ileums were numerically lower in the N/V group than the N/N and N/P groups but the differences were not significant (FIG. 31A).

At D34, only distal jejunums, ileums, and ceca of the N/V group and ceca of the N/P group were positive for PEDV IHC staining. The N/V group had significantly higher average IHC scores in distal jejunums and ileums than the N/P and N/N groups (FIG. 31B).

Evaluation of cross-protection efficacy. Following the 2nd inoculation at D28, the 7 groups (P/V, V/V, N/V, P/P, V/P, N/P and N/N) were compared to evaluate the effect of previous exposure (the 1st inoculation at D0) on the outcomes of the subsequent challenge (the 2nd inoculation at D28).

After the 2nd inoculation (D28), watery diarrhea was observed only in V/V and N/V groups between D33 and D38, and diarrhea was not observed in any other groups.

Fecal virus shedding was compared among 7 groups after the 2nd inoculation at D28 (FIG. 1). For 3 groups challenged with the V-strain, the P/V and V/V groups overall shed similar amounts of virus during D28-D56 (P=0.9422); but both P/V and V/V groups shed significantly lower amounts of virus than the N/V group (P<0.0001). For 3 groups challenged with the P-strain, the V/P and P/P groups shed significantly less amounts of virus than the N/P group during D28-D56 (P<0.0001), yet the V/P group, which shed sharply higher amount of virus on D34 than the other days, was shedding significantly more viruses than the P/P group from D28 to D56 (P=0.0001).

At D34 (6 days post challenge), among 3 groups challenged with the V-strain (NN, V/V and P/V groups), some minor macro-pathological changes were only observed in the N/V groups but were not apparent in the V/V and P/V groups. The average content scores and organ lesions in small intestines were not significantly different among N/V, V/V and P/V groups. But the average content scores in ceca and colons as well as the average lesion scores in colons were significantly lower in the V/V and P/V groups than the N/V group (FIG. 29B). The V/V and P/V groups had numerically higher average VH/CD ratios in distal jejunums and ileums than the N/V group; however, significant differences were only observed between the N/V and V/V groups in distal jejunum and ileum VH/CD ratios as well as between the V/V and P/V groups in distal jejunum VH/CD ratios (FIG. 31A). The V/V and P/V groups both had significantly lower average IHC scores in distal jejunums and ileums than the N/V group (FIG. 31B).

At D34, among 3 groups challenged with the P-strain (N/P, V/P and P/P groups), macro- and microscopic pathological changes were not evident in any groups and no significant differences were observed between any groups regarding the average content scores and tissue lesions (FIG. 29B), average VH/CD ratios (FIG. 31A), or average IHC scores (FIG. 31B).

Antibody Responses.

After the 1st inoculation, all pigs inoculated with the P-strain (P/P and P/V groups) or V-strain (V/V and V/P group) developed IFA and VN antibodies starting from D7-D14 regardless of which virus strain was used as the indicator virus (FIG. 32A, 32B, 33A, 33B). Average antibody titers peaked at D21 and D28 of all PEDV inoculated groups. PEDV antibody titers in these four groups increased slightly after the challenge at D28 and then were maintained throughout the end of the study (D56). The N/P and N/V groups were PEDV antibody negative until D42 (14 days post the 2nd inoculation) when IFA and VN antibodies became detectable and were maintained through D56. The N/N group remained PEDV antibody negative from D0-56.

SUMMARY

It appears that U.S. PEDV prototype strain achieved higher levels of fecal virus shedding than S-INDEL-variant strain in 3-week-old pigs but the opposite was observed in 7-week-old pigs. However, this observation needs to be further confirmed to determine optimal ages at which Prototype and INDEL vaccines provide peak efficacy in older pigs. U.S. PEDV prototype strain provided protection against challenge with both homologous and heterologous strains in weaned pigs; U.S. PEDV S-INDEL-variant strain provided protection against homologous strain challenge and at least partial protection against heterologous (prototype) strain challenge in weaned pigs.

REFERENCES

1. Stevenson G W, Hoang H, Schwartz K J, Burrough E B, Sun D, Madson D, Cooper V L, Pillatzki A, Gauger P, Schmitt B J, Koster L G, Killian M L, and Yoon K J. (2013). Emergence of porcine epidemic diarrhea virus in the United States: clinical signs, lesions, and viral genomic sequences. Journal of Veterinary Diagnostic Investigation 25(5): 649-654.
2. Chen Q, Li G, Stasko J, Thomas J T, Stensland W R, Pillatzki A E, Gauger P C, Schwartz K J, Madson D, Yoon K J, Stevenson G W, Burrough E R, Harmon K M, Main R G, and Zhang J. (2014). Isolation and characterization of porcine epidemic diarrhea viruses associated with the 2013 disease outbreak among swine in the United States. Journal of Clinical Microbiology 52(1), 234-243.
3. Wang L, Byrum B, and Zhang Y. (2014). New variant of porcine epidemic diarrhea virus, United States, 2014. Emerging Infectious Diseases 20(5), 917-919.
4. Vlasova A, Marthaler D, Wang Q, Culhane M R, Rossow K D, Rovira A, Collins J & Saif L J. (2014). Distinct characteristics and complex evolution of PEDV strains, North America, May 2013-February 2014. Emerging Infectious Diseases 20(10), 1620-1628.
5. Chen Q, Gauger P C, Stafne M R, Thomas J T, Madson D M, Huang H, Zheng Y, Li G, and Zhang J. Pathogenesis comparison between the United States porcine epidemic diarrhea virus prototype and S-INDEL-variant strains in conventional neonatal piglets. Journal of General Virology (in press)
6. Thomas J T, Chen Q, Gauger P C, Gimenez-Lirola L G, Sinha A, Harmon K M, Madson D M, Burrough E R, Magstadt D R, Salzbrenner H, Welch M W, Yoon K J, Zimmerman J J, and Zhang J. (2015). Effect of porcine epidemic diarrhea virus infectious doses on infection outcomes in naïve neonatal and weaned pigs. PLoS ONE 10(10):e0139266.
7. Jung K, Annamalai T, Lu Z & Saif L J. (2015). Comparative pathogenesis of US porcine epidemic diarrhea virus (PEDV) strain PC21A in conventional 9-day-old nursing piglets vs. 26-day-old weaned pigs. Veterinary Microbiology 178, 31-40.

TABLE OF SEQUENCES

| | |
|---|---|
| SEQ ID NO: 1 | S1 sequence of PEDV variant strain |
| SEQ ID NO: 2 | Spike gene 2014020697-P5 |
| SEQ ID NO: 3 | Spike gene 2013019338-P3 |
| SEQ ID NO: 4 | Spike gene 2013022038-P3 |
| SEQ ID NO: 5 | Spike gene 2013035140-P3 |
| SEQ ID NO: 6 | Spike gene 2013049379-P3 |
| SEQ ID NO: 7 | Spike gene 2013049469-P1 |
| SEQ ID NO: 8 | Whole genome 2014020697-P5 |
| SEQ ID NO: 9 | Whole genome 2013019338-P3 |
| SEQ ID NO: 10 | Whole genome 2013022038-P3 |
| SEQ ID NO: 11 | Whole genome 2013035140-P3 |
| SEQ ID NO: 12 | Whole genome 2013049379-P3 |
| SEQ ID NO: 13 | Whole genome 2013049469-P1 |
| SEQ ID NO: 14 | Complete genome 2014020697-P5 |
| SEQ ID NO: 15 | Genomic sequence 2014020697-P7R1 |
| SEQ ID NO: 16 | Genomic sequence 2014020697-P5 |
| SEQ ID NO: 17 | 2014020697-P8R1 ORF1a/1b polyprotein |
| SEQ ID NO: 18 | 2014020697-P8R1 spike protein |
| SEQ ID NO: 19 | 2014020697-P8R1 ORF 3 protein (truncated) |
| SEQ ID NO: 20 | 2014020697-P8R1 envelope protein |
| SEQ ID NO: 21 | 2014020697-P8R1 membrane protein |
| SEQ ID NO: 22 | 2014020697-P8R1 nucleocapsid protein |
| SEQ ID NO: 23 | 2014020697-P18R1 clone G8b ORF1a/1b polyprotein |
| SEQ ID NO: 24 | 2014020697-P18R1 clone G8b spike protein |
| SEQ ID NO: 25 | 2014020697-P18R1 clone G8b ORF 3 protein (truncated) |
| SEQ ID NO: 26 | 2014020697-P18R1 clone G8b envelope protein |
| SEQ ID NO: 27 | 2014020697-P18R1 clone G8b membrane protein |
| SEQ ID NO: 28 | 2014020697-P18R1 clone G8b nucleocapsid protein |
| SEQ ID NO: 29 | 2014020697-P18R1 clone F6a ORF1a/1b polyprotein |
| SEQ ID NO: 30 | 2014020697-P18R1 clone F6a spike protein |
| SEQ ID NO: 31 | 2014020697-P18R1 clone F6a ORF 3 (truncated) |
| SEQ ID NO: 32 | 2014020697-P18R1clone F6a envelope protein |
| SEQ ID NO: 33 | 2014020697-P18R1 clone F6a membrane protein |
| SEQ ID NO: 34 | 2014020697-P18R1 clone F6a nucleocapsid protein |
| SEQ ID NO: 35 | 2014020697-P8R1 genomic sequence |
| SEQ ID NO: 36 | 2014020697-P18R1 clone G8b genomic sequence |
| SEQ ID NO: 37 | 2014020697-P18R1 clone F6a genomic sequence |
| SEQ ID NO: 38 | 2014020697-P8R1 genomic sequence |
| SEQ ID NO: 39 | 2014020697-P45 genomic sequence |
| SEQ ID NO: 40 | 2014020697-P45 ORF1a/1b polyprotein sequence |
| SEQ ID NO: 41 | 2014020697-P45 Spike protein |
| SEQ ID NO: 42 | 2014020697-P45 ORF3 protein |
| SEQ ID NO: 43 | 2014020697-P45 Envelope protein |
| SEQ ID NO: 44 | 2014020697-P45 Membrane protein |
| SEQ ID NO: 45 | 2014020697-P45 Nucleocapsid protein |
| SEQ ID NO: 46 | 2014020697-P5 ORF1 polyprotein 1a/1b |
| SEQ ID NO: 47 | 2014020697-P5 Spike protein |
| SEQ ID NO: 48 | 2014020697-P5 ORF3 protein |
| SEQ ID NO: 49 | 2014020697-P5 Envelope protein |
| SEQ ID NO: 50 | 2014020697-P5 Membrane protein |
| SEQ ID NO: 51 | 2014020697-P5 Nucleocapsid protein |
| SEQ ID NO: 52 | USA/IN19338/23013-P3 ORF1 polyprotein 1a/1b |
| SEQ ID NO: 53 | USA/IN19338/23013-P3 polyprotein 1a |
| SEQ ID NO: 54 | USA/IN19338/23013-P3 Spike protein |
| SEQ ID NO: 55 | USA/IN19338/23013-P3 ORF3 protein |
| SEQ ID NO: 56 | USA/IN19338/23013-P3 Envelope protein |
| SEQ ID NO: 57 | USA/IN19338/23013-P3 Membrane protein |
| SEQ ID NO: 58 | USA/IN19338/23013-P3 Nucleocapsid protein |
| SEQ ID NO: 59 | USA/IN19338/23013-P7 Genomic sequence |
| SEQ ID NO: 60 | USA/NC35140/2013-P7 Genomic Sequence |
| SEQ ID NO: 61 | USA/NC49469/2013-P7 Genomic Sequence |
| SEQ ID NO: 62 | 2014020697-P7 Genomic Sequence |
| SEQ ID NO: 63 | 2014020697-P3 Genomic sequence |
| SEQ ID NO: 64 | 2014020697-P18 Genomic sequence |
| SEQ ID NO: 65 | 2014020697-P30 Genomic sequence |
| SEQ ID NO: 66 | 2014020697-P60 Genomic sequence |
| SEQ ID NO: 67 | 2014020697-P3R1 Genomic sequence |
| SEQ ID NO: 68 | 2014020697-P5R1 Genomic sequence |
| SEQ ID NO: 69 | USA/IN19338/2013 Homogenate Genomic sequence |
| SEQ ID NO: 70 | USA/IN19338/2013-P9 Genomic sequence |
| SEQ ID NO: 71 | USA/IN19338/2013-P25 Genomic sequence |

TABLE OF SEQUENCES

| | |
|---|---|
| SEQ ID NO: 72 | USA/IN19338/2013-P50 Genomic sequence |
| SEQ ID NO: 73 | USA/IN19338/2013-P65 Genomic sequence |
| SEQ ID NO: 74 | USA/IN19338/2013-P75 Genomic sequence |
| SEQ ID NO: 75 | USA/IN19338/2013-P100 Genomic sequence |
| SEQ ID NO: 76 | 2014020697-P19R1 G8b Genomic sequence |
| SEQ ID NO: 77 | 2014020697-P19R1 F6a Genomic sequence |
| SEQ ID NO: 78 | 2014020697-P38 Genomic sequence |

While specific embodiments have been described above with reference to the disclosed embodiments and examples, such embodiments are only illustrative and do not limit the scope of the invention. Changes and modifications can be made in accordance with ordinary skill in the art without departing from the invention in its broader aspects as defined in the following claims.

All publications, patents, and patent documents are incorporated by reference herein, as though individually incorporated by reference. The invention has been described with reference to various specific and preferred embodiments and techniques. However, it should be understood that many variations and modifications may be made while remaining within the spirit and scope of the invention.

The inventions being thus described, it will be obvious that the same may be varied in many ways. Such variations are not to be regarded as a departure from the spirit and scope of the inventions.

SEQUENCE LISTING (78 sequences)

SEQ ID NO: 1 - DNA, 2205 bp, Porcine Epidemic Diarrhea Virus
atgaagtctttaaattacttctggttgttcttaccagtactttcaacactcagcctaccacaagatgtcactaggtgccagtccactattaacttcaggcggttcttttcaaaatttaatgtgcaggcacctgctgtcgttgtgttgggtggttatctacctagtatgaattcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattct

SEQ ID NO: 2 - DNA, 4152 bp, Porcine Epidemic Diarrhea Virus
atgaagtctttaaattacttctggttgttcttaccagtactttcaacactcagcctaccacaagatgtcactaggtgccagtccactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgcttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccatttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtga

SEQ ID NO: 3 - DNA, 4161 bp, Porcine Epidemic Diarrhea Virus
atgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctttgggtgctacccaagtaccctattattgtttttttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtga

SEQ ID NO: 4 - DNA, 4161 bp, Porcine Epidemic Diarrhea Virus
atgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgcatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctttgggtgctacccaagtaccctattattgttttcttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccacgtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagcattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtga

SEQ ID NO: 5 - DNA, 4161 bp, Porcine Epidemic Diarrhea Virus
atgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcactggttatgctgccaatgtatttgctactgagcccaatggccacataccagaaggttttagttttaataattggtttcttttgtccaatgattccactttggtgcatggtaaggtggtttctaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtgatgttaagtttacgtccctttactttcaattcacaaagggtgagttgattactggcacgcctaaaccatttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtga

SEQ ID NO: 6 - DNA, 4161 bp, Porcine Epidemic Diarrhea Virus
atgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttactaattggtttcttttgtccaatgattccactttggtacatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctttgggtgctacccaagtaccctattattgttttcttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgactaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaatcgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtga

SEQ ID NO: 7 - DNA, 4161 bp, Porcine Epidemic Diarrhea Virus
atgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcccagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagctaccttcgccatacctctgggtgctacccaagtaccttattattgtttttttaaagtggatacttacaactccactgtttataaatttttggctgttttacctcctaccgtcagggaaattgtcatcaccaagtatggtgatgtttatgtcaatggggttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacattactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattttggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttgttgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcttgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggtagaccgtctcatcaacggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccttggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtga

SEQ ID NO: 8 - DNA, 28029 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatctgatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgttggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtttatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaacaaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgcttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccatttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcctttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaatagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 9 - DNA, 28038 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtgattacgcgcgctggtgctggcactggtgttaagtattacaacaacatgttcctgcgccatgtggcagacattgatgggttgtcattctggcgaattctcaaggtgcagtccaaagacgacctcgcttgctctggtaaattccttgaacaccacgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgtaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttctgacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtatggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctttgggtgctacccaagtaccctattattgtttttttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcattctactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 10 - DNA, 27937 bp, Porcine Epidemic Diarrhea Virus
acttaaagagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatcttctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcttaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgcatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctttgggtgctacccaagtaccctattattgttttcttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccacgtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagcattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 11 - DNA, 28037 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgcaccttacatttcacagcaccaagttatatggaggctgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgttagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttttagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacactcgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttctctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaacactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgacgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaatacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctttatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttttgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcactggttatgctgccaatgtatttgctactgagcccaatggccacataccagaaggttttagttttaataattggtttcttttgtccaatgattccactttggtgcatggtaaggtggtttctaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtgatgttaagtttacgtccctttactttcaattcacaaagggtgagttgattactggcacgcctaaaccatttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaattttgaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 12 - DNA, 28038 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccattgcaagtgctgtgctgtcctctagttcctggttggcgttccgtcgccttctacacactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctgggttgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaatatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggaaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtttttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtggtcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaatcgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgactttaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacgacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgatggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttactaattggtttcttttgtccaatgattccactttggtacatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctttgggtgctacccaagtaccctattattgttttcttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgactaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaatcgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttttactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 13 - DNA, 28038 bp, Porcine Epidemic Diarrhea Virus
acttaaagagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatctttctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgcctttcagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccttgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaactccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgttaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacatacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgagaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaattatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatatggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaagtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagtactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaataagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatacaagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcggggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcccagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagctaccttcgccatacctctgggtgctacccaagtaccttattattgtttttttaaagtggatacttacaactccactgtttataaatttttggctgttttacctcctaccgtcagggaaattgtcatcaccaagtatggtgatgtttatgtcaatggggttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacattactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattttggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttgttgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcttgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggtagaccgtctcatcaacggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccttggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaggcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccttccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatttgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 14 - DNA, 28029 bp, Porcine Epidemic Diarrhea Virus; identical to SEQ ID NO: 8

SEQ ID NO: 15 - DNA, 28025 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgttttgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaataaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttttgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactattaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataactccagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagctttgacggcaaatccattgtgattttagaaggtggtgaccattacatcacttttggcaactcctttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatcacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 16 - DNA, 28029 bp, Porcine Epidemic Diarrhea Virus; identical to SEQ ID NO: 8

SEQ ID NO: 17 - protein, 6781 aa, Porcine Epidemic Diarrhea Virus
MASNHVTLAFANDAEISAFGFCTASEAVSYYSEAAASGFMQCRFVSFDLADTVEGLLPEDYVMVVVGTTKLSAYVDTFGSRPKNICGWLLFSNCNYFLEELELTFGRRGGNIVPVDQYMCGADGKPVLQESEWEYTDFFADSEDGQLNIAGITYVKAWIVERSDVSYASQNLTSIKSITYCSTYEHTFPDGTAMKVARTPKIKKTVVLSEPLATIYREIGSPFVDNGSDARSIIKRPVFLHAFVKCKCGSYHWTVGDWTSYVSTCCGFKCKPVLVASCSATPGSVVVTRAGAGTGVKYYNNMFLRHVADIDGLAFWRILKVQSKDDLACSGKFLEHHEEGFTDPCYFLNDSSIATKLKFDILSGKFSDEVKQAIFAGHVVVGSALVDIVDDALGQPWFIRKLGDLASAAWEQLKAVVRGLNLLSDEVVLFGKRLSCATLSIVNGVFEFIAEVPEKLAAAVTVFVNFLNELFESACDCLKVGGKTFNKVGSYVLFDNALVKLVKAKVRGPRQAGVCEVRYTSLVIGSTTKVVSKRVENANVNLVVVDEDATLNTTGRTVVVDGLAFFESDGFYRHLADADVVIEHPVYKSACELKPVFECDPIPDFPMPVAASVAELCVQTDLLLKNYNTPYKTYSCVVRGDKCCITCTLHFTAPSYMEAAANFVDLCTKNIGTAGFHEFYITAHEQQDLQGFVTTCCTMSGFECFMPIIPQCPAVLEEIDGGSIWRSFITGLNTMWDFCKHLKVSFGLDGIVVTVARKFKRLGALLAEMYNTYLSTVVENLVLAGVSFKYYATSVPKIVLGCCFHSVKSVLASAFQIPVQAGVEKFKVFLNCVHPVVPRVIETSFVELEETTFKPPALNGSIAIVDGFAFYYDGTLYYPTDGNSVVPICFKKKGGGDVKFSDEVSVKTIDPVYKVSLEFEFESETIMAVLNKAVGNCIKVTGGWDDVVEYINVAIEVLKDHIDVPKYYIYDEEGGTDPNLPVMVSQWPLNDDTISQDLLDVEVVTDAPVDFEGDEVDSSDPDKVADVANSEPEDDGLNVAPETNVESEVEEVAATLSFIKDTPSTVTKDPFAFDFASYGGLKVLRQSHNNCWVTSTLVQLQLLGIVDDPAMELFSAGRVGPMVRKCYESQKAILGSLGDVSACLESLTKDLHTLKITCSVVCGCGTGERIYDGCAFRMTPTLEPFPYGACAQCAQVLMHTFKSIVGTGIFCRDTTALSLDSLVVKPLCAAAFIGKDSGHYVTNFYDAAMAIDGYGRHQIKYDTLNTICVKDVNWTAPFVPDVEPVLEPVVKPFYSYKNVDFYQGDFSDLVKLPCDFVVNAANENLSHGGGIAKAIDVYTRGMLQKCSNDYIKAHGPIKVGRGVMLEALGLKVFNVVGPRKGKHAPELLVKAYKSVFANSGVALTPLISVGIFSVPLEESLSAFLACVGDRHCKCFCYSDKEREAIINYMDGLVDAIFKDALVDTTPVQEDVQQVSQKPVLPNFEPFRIEGAHAFYECNPEGLMSLGADKLVLFTNSNLDFCSVGKCLNNVTGGALLEAINVFKKSNKTVPAGNCVTFECADMISITMVVLPSDGDANYDKNYARAVVKVSKLKGKLLLAVGDAMLYSKLSHLSVLGFVSTPDDVERFYANKSVVIKVTEDTRSVKTVKVESTVTYGQQIGPCLVNDTVVTDNKPVVADVVAKVVPSANWDSHYGFDKAGEFHMLDHTGFAFPSEVVNGRRVLKTTDNNCWVNVTCLQLQFARFRFKSAGLQAMWESYCTGDVAMFVHWLYWLTGVDKGQPSDSENALNMLSKYIVPAGSVTIERVTHDGCCCSKRVVTAPVVNASVLKLGVEDGLCPHGLNYIDKVVVVKGTTIVVNVGKPVVAPSHLFLKGVSYTTFLDNGNGVAGHYTVFDHDTGMVHDGDVFVPGDLNVSPVTNVVVSEQTAVVIKDPVKKVELDATKLLDTMNYASERFFSFGDFMSRNLITVFLYILSILGLCFRAFRKRDVKVLAGVPQRTGIILRKSVRYNAKALGVFFKLKLYWFKVLGKFSLGIYALYALLFMTIRFTPIGGPVCDDVVAGYANSSFDKNEYCNSVICKVCLYGYQELSDFSHTQVVWQHLRDPLIGNVMPFFYLAFLAIFGGVYVKAITLYFIFQYLNILGVFLGLQQSIWFLQLVPFDVFGDEIVVFFIVTRVLMFLKHVFLGCDKASCVACSKSARLKRVPVQTIFQGTSKSFYVHANGGSKFCKKHNFFCLNCDSYGPGCTFINDVIATEVGNVVKLNVQPTGPATILIDKVEFSNGFYYLYSGDTFWKYNFDITDNKYTCKESLKNCSIITDFIVFNNNGSNVNQVKNACVYFSQMLCKPVKLVDSALLASLSVDFGASLHSAFVSVLSNSFGKDLSSCNDMQDCKSTLGFDDVPLDTFNAAVAEAHRYDVLLTDMSFNNFTTSYAKPEEKLPVHDIATCMRVGAKIVNHNVLVKDSIPVVWLVRDFIALSEETRKYIIRTTKVKGITFMLTFNDCRMHTTIPTVCIANKKGAGLPSFSKVKKFFWFLCLFIVAVFFALSFFDFSTQVSSDSDYDFKYIESGQLKTFDNPLSCVHNVFSNFDQWHDAKFGFTPVNNPSCPIVVGVSDEARTVPGIPAGVYLAGKTLVFAINTIFGTSGLCFDASGVADKGACIFNSACTTLSGLGGTAVYCYKNGLVEGAKLYSELAPHSYYKMVDGNTVSLPEIISRGFGIRTIRTKAMTYCRVGQCVQSAEGVCFGADRFFVYNAESGSDFVCGTGLFTLLMNVISVFSKTVPVTVLSGQILFNCIIAFAAVAVCFLFTKFKRMFGDMSVGVFTVGACTLLNNVSYIVTQNTLGMLGYATLYFLCTKGVRYMWIWHLGFLISYILIAPWWVLMVYAFSAIFEFMPNLFKLKVSTQLFEGDKFVGSFENAAAGTFVLDMHAYERLANSISTEKLRQYASTYNKYKYYSGSASEADYRLACFAHLAKAMMDYASNHNDTLYTPPTVSYNSTLQAGLRKMAQPSGVVEKCIVRVCYGNMALNGLWLGDTVICPRHVIASSTTSTIDYDYALSVLRLHNFSISSGNVFLGVVGVTMRGALLQIKVNQNNVHTPKYTYRTVRPGESFNILACYDGSAAGVYGVNMRSNYTIRGSFINGACGSPGYNINNGTVEFCYLHQLELGSGCHVGSDLDGVMYGGYEDQPTLQVEGASSLFTENVLAFLYAALINGSTWWLSSSRIAVDRFNEWAVHNGMTTVVNTDCFSILAAKTGVDVQRLLASIQSLHKNFGGKQILGYTSLTDEFTTGEVIRQMYGVNLQSGYVSRACRNVLLVGSFLTFFWSELVSYTKFFWVNPGYVTPMFACLSLLSSLLMFTLKHKTLFFQVFLIPALIVTSCINLAFDVEVYNYLAEHFDYHVSLMGFNAQGLVNIFVCFVVTILHGTYTWRFFNTPVSSVTYVVALLTAAYNYFYASDILSCAMTLFASVTGNWFVGAVCYKAAVYMALRFPTFVAIFGDIKSVMFCYLVLGYFTCCFYGILYWFNRFFKVSVGVYDYTVSAAEFKYMVANGLRAPTGTLDSLLLSAKLIGIGGERNIKISSVQSKLTDIKCSNVVLLGCLSSMNVSANSTEWAYCVDLHNKINLCNDPEKAQEMLLALLAFFLSKNSAFGLDDLLESYFNDNSMLQSVASTYVGLPSYVIYENARQQYEDAVNNGSPPQLVKQLRHAMNVAKSEFDREASTQRKLDRMAEQAAAQMYKEARAVNRKSKVVSAMHSLLFGMLRRLDMSSVDTILNLAKDGVVPLSVIPAVSATKLNIVTSDIDSYNRIQREGCVHYAGTIWNIIDIKDNDGKVVHVKEVTAQNAESLSWPLVLGCERIVKLQNNEIIPGKLKQRSIKAEGDGIVGEGKALYNNEGGRTFMYAFISDKPDLRVVKWEFDGGCNTIELEPPRKFLVDSPNGAQIKYLYFVRNLNTLRRGAVLGYIGATVRLQAGKQTEQAINSSLLTLCAFAVDPAKTYIDAVKSGHKPVGNCVKMLANGSGNGQAVTNGVEASTNQDSYGGASVCLYCRAHVEHPSMDGFCRLKGKYVQVPLGTVDPIRFVLENDVCKVCGCWLANGCTCDRSIMQSTDMAYLNRVRGSSAARLEPCNGTDTQHVYRAFDIYNKDVACLGKFLKVNCVRLKNLDKHDAFYVVKRCTKSAMEHEQSIYSRLEKCGAVAEHDFFTWKDGRAIYGNVCRKDLTEYTMMDLCYALRNFDENNCDVLKSILIKVGACEESYFNNKVWFDPVENEDIHRVYALLGTIVSRAMLKCVKFCDAMVEQGIVGVVTLDNQDLNGDFYDFGDFTCSIKGMGIPICTSYYSYMMPVMGMTNCLASECFVKSDIFGEDFKSYDLLEYDFTEHKTALFNKYFKYWGLQYHPNCVDCSDEQCIVHCANFNTLFSTTIPITAFGPLCRKCWIDGVPLVTTAGYHFKQLGIVWNNDLNLHSSRLSINELLQFCSDPALLIASSPALVDQRTVCFSVAALGTGMTNQTVKPGHFNKEFYDFLLEQGFFSEGSELTLKHFFFAQKGDAAVKDFDYYRYNRPTVLDICQARVVYQIVQRYFDIYEGGCITAKEVVVTNLNKSAGYPLNKFGKAGLYYESLSYEEQDELYAYTKRNILPTMTQLNLKYAISGKERARTVGGVSLLSTMTTRQYHQKHLKSIVNTRGASVVIGTTKFYGGWDNMLKNLIDGVENPCLMGWDYPKCDRALPNMIRMISAMILGSKHTTCCSSTDRFFRLCNELAQVLTEVVYSNGGFYLKPGGTTSGDATTAYANSVFNIFQAVSANVNKLLSVDSNVCHNLEVKQLQRKLYECCYRSTTVDDQFVVEYYGYLRKHFSMMILSDDGVVCYNNDYASLGYVADLNAFKAVLYYQNNVFMSASKCWIEPDINKGPHEFCSQHTMQIVDKDGTYYLPYPDPSRILSAGVFVDDVVKTDAVVLLERYVSLAIDAYPLSKHENPEYKKVFYVLLDWVKHLYKTLNAGVLESFSVTLLEDSTAKFWDESFYANMYEKSAVLQSAGLCVVCGSQTVLRCGDCLRRPMLCTKCAYDHVIGTTHKFILAITPYVCCASDCGVNDVTKLYLGGLSYWCHDHKPRLAFPLCSAGNVFGLYKNSATGSPDVEDFNRIATSDWTDVSDYRLANDVKDSLRLFAAETIKAKEESVKSSYACATLHEVVGPKELLLKWEVGRPKPPLNRNSVFTCYHITKNTKFQIGEFVFEKAEYDNDAVTYKTTATTKLVPGMVFVLTSHNVQPLRAPTIANQERYSTIHKLHPAFNIPEAYSSLVPYYQLIGKQKITTIQGPPGSGKSHCVIGLGLYYPGARIVFTACSHAAVDSLCVKASTAYSNDKCSRIIPQRARVECYDGFKSNNTSAQYLFSTVNALPECNADIVVVDEVSMCTNYDLSVINQRISYRHVVYVGDPQQLPAPRVMISRGTLEPKDYNVVTQRMCALKPDVFLHKCYRCPAEIVRTVSEMVYENQFIPVHPDSKQCFKIFCKGNVQVDNGSSINRRQLDVVRMFLAKNPRWSKAVFISPYNSQNYVASRMLGLQIQTVDSSQGSEYDYVIYTQTSDTAHACNVNRFNVAITRAKKGILCIMCDRSLFDVLKFFELKLSDLQANEGCGLFKDCSRGDDLLPPSHANTFMSLADNFKTDQDLAVQIGVNGPIKYEHVISFMGFRFDINIPNHHTLFCTRDFAMRNVRGWLGFDVEGAHVVGSNVGTNVPLQLGFSNGVDFVVRPEGCVVTESGDYIKPVRARAPPGEQFAHLLPLLKRGQPWDVVRKRIVQMCSDYLANLSDILIFVLWAGGLELTTMRYFVKIGPSKSCDCGKVATCYNSALHTYCCFKHALGCDYLYNPYCIDIQQWGYKGSLSLNHHEHCNVHRNEHVASGDAIMTRCLAIHDCFVKNVDWSITYPFIGNEAVINKSGRIVQSHTMRSVLKLYNPKAIYDIGNPKGIRCAVTDAKWFCFDKNPTNSNVKTLEYDYITHGQFDGLCLFWNCNVDMYPEFSVVCRFDTRCRSPLNLEGCNGGSLYVNNHAFHTPAFDKRAFAKLKPMPFFFYDDTECDKLQDSINYVPLRASNCITKCNVGGAVCSKHCAMYHSYVNAYNTFTSAGFTIWVPTSFDTYNLWQTFSNNLQGLENIAFNVVKKGSFVGAEGELPVAVVNDKVLVRDGTVDTLVFTNKTSLPTNVAFELYAKRKVGLTPPITILRNLGVVCTSKCVIWDYEAERPLTTFTKDVCKYTDFEGDVCTLFDNSIVGSLERFSMTQNAVLMSLTAVKKLTGIKLTYGYLNGVPVNTHEDKPFTWYIYTRKNGKFEDHPDGYFTQGRTTADFSPRSDMEKDFLSMDMGLFINKYGLEDYGFEHVVYGDVSKTTLGGLHLLISQVRLACMGVLKIDEFVSSNDSTLKSCTVTYADNPSSKMVCTYMDLLLDDFVSILKSLDLSVVSKVHEVMVDCKMWRWMLWCKDHKLQTFYPQLQASEWKCGYSMPSIYKIQRMCLEPCNLYNYGAGIKLPDGIMFNVVKYTQLCQYLNSTTMCVPHHMRVLHLGAGSDKGVAPGTAVLRRWLPLDAIIVDNDSVDYVSDADYSVTGDCSTLYLSDKFDLVISDMYDGKIKSCDGENVSKEGFFPYINGVITEKLALGGTVAIKVTEFSWNKKLYELIQKFEYWTMFCTSVNTSSSEAFLIGVHYLGDFASGAVIDGNTMHANYIFWRNSTIMTMSYNSVLDLSKFNCKHKATVVINLKDSSISDVVLGLLKNGKLLVRNNDAICGFSNHLVNVNK

SEQ ID NO: 18 - protein, 1383 aa, Porcine Epidemic Diarrhea Virus
MKSLNYFWLFLPVLSTLSLPQDVTRCQSTINFRRFFSKFNVQAPAVVLLGGYLPSMNSSSWYCGTGLETASGVHGIFLSYIDAGQGFEIGISQEPFDPSGYQLYLHKATNGNHNAIARLRICQFPDNKTLGPTVNDVTTGRNCLFNKAIPAYMQDGKNIVVGITWDNDRVTVFADKIYHFYLKNDWSRVATRCYNKRSCAMQYVYTPTYYMLNVTSAGEDGIYYEPCTANCSGYAANVFATDSNGHIPEGFSFNNWFLLSNDSTLLHGKVVSNQPLLVNCLLAIPKIYGLGQFFSFNQTMDGVCNGAAAQRAPEALRFNINDTSVILAEGSIVLHTALGTNLSFVCSNSSDPHLATFAIPLGATQVPYYCFLKVDTYNSTVYKFLAVLPPTVREIVITKYGDVYVNGFGYLHLGLLDAVTINFTGHGTDDDVSGFWTIASTNFVDALIEVQGTAIQRILYCDDPVSQLKCSQVAFDLDDGFYPISSRNLLSHEQPISFVTLPSFNDHSFVNITVSASFGGHSGANLIASDTTINGFSSFCVDTRQFTISLFYNVTNSYGYVSKSQDSNCPFTLQSVNDYLSFSKFCVSTSLLASACTIDLFGYPEFGSGVKFTSLYFQFTKGELITGTPKPLEGVTDVSSMTLDVCTKYTIYGFKGEGIITLTNSSFLAGVYYTSDSGQLLAFKNVTSGAVYSVTPCSFSEQAAYVDDDIVGVISSLSSSTFNSTRELPGFFYHSNDGSNCTEPVLVYSNIGVCKSGSIGYVPSQSGQVKIAPTVTGNISIPTNFSMSIRTEYLQLYNTPVSVDCATYVCNGNSRCKQLLTQYTAACKTIESALQLSARLESVEVNSMLTISEEALQLATISSFNGDGYNFTNVLGVSVYDPASGRVVQKRSFIEDLLFNKVVTNGLGTVDEDYKRCSNGRSVADLVCAQYYSGVMVLPGVVDAEKLHMYSASLIGGMVLGGFTSAAALPFSYAVQARLNYLALQTDVLQRNQQLLAESFNSAIGNITPAFESVKEAISQTSKGLNTVAHALTKVQEVVNSQGAALTQLTVQLQHNFQAISSSIDDIYSRLDILSADVQVDRLITGRLSALNAFVAQTLTKYTEVQASRKLAQQKVNECVKSQSQRYGFCGGDGEHIFSLVQAAPQGLLFLHTVLVPSDFVDVIAIAGLCVNDEIALTLREPGLVLFTHELQNHTATEYFVSSRRMFEPRKPTVSDFVQIESCVVTYVNLTRDQLPDVIPDYIDVNKTLDEILASLPNRTGPSLPLDVFNATYLNLTGEIADLEQRSESLRNTTEELQSLIYNINNTLVDLEWLNRVETYIKWPWWVWLIIFIVLIFVVSLLVFCCISTGCCGCCGCCCACFSGCCRGPRLQPYEVFEKVHVQ

SEQ ID NO: 19 - protein, 143 aa, Porcine Epidemic Diarrhea Virus
MFLGLFQYTIDTVVKDVSKSANLSLDAVQELELNVVPIRQASNVTGFLFTSVFIYFFALFKASSLRRNYIMLAARFAVIVLYCPLLYYCGAFLDATIICCTLIGRLCLVCFYSWRYKNALFIIFNTTTLSFLNGKAALTANPL

SEQ ID NO: 20 - protein, 76 aa, Porcine Epidemic Diarrhea Virus
MLQLVNDNGLVVNVILWLFVLFFLLIISITFVQLVNLCFTCHRLCNSAVYTPIGRLYRVYKSYMQIDPLPSTVIDV

SEQ ID NO: 21 - protein, 226 aa, Porcine Epidemic Diarrhea Virus
MSNGSIPVDEVIQHLRNWNFTWNIILTILLVVLQYGHYKYSAFLYGVKMAILWILWPLVLALSLFDAWASFQVNWVFFAFSILMACITLMLWIMYFVNSIRLWRRTHSWWSFNPETDALLTTSVMGRQVCIPVLGAPTGVTLTLLSGTLLVEGYKVATGVQVSQLPNFVTVAKATTTIVYGRVGRSVNASSGTGWAFYVRSKHGDYSAVSNPSSVLTDSEKVLHLV

SEQ ID NO: 22 - protein, 441 aa, Porcine Epidemic Diarrhea Virus
MASVSFQDRGRKRVPLSLYAPLRVTNHKPLSKVLANNAVPTNKGNKDQQIGYWTEQIRWRMRRGERIEQPSNWHFYYLGTGPHADLRYRTRTEGVFWVAKEGAKTEPTNLGVRKASEKPIIPNFSQQLPSVVEIVEPNTPPTSRANSRSRSRGNGNNRSRSPSNNRGNNQSRGNSQNRGNNQGRGASQNRGGNNNNNNKSRNQSKNRNQSNDRGGVTSRDDLVAAVKDALKSLGIGENPDKLKQQQKPKQERSDSSGKNTPKKNKSRATSKERDLKDIPEWRRIPKGENSVAACFGPRGGFKNFGDAEFVEKGVDASGYAQIASLAPNVAALLFGGNVAVRELADSYEITYNYKMTVPKSDPNVELLVSQVDAFKTGNAKPQRKKEKKNKRETTQQLNEEAIYDDVGVPSDVTHANLEWDTAVDGGDTAVEIINEIFDTGN

SEQ ID NO: 23 - protein, 6781 aa, Porcine Epidemic Diarrhea Virus; identical to SEQ ID NO: 17

SEQ ID NO: 24 - protein, 1383 aa, Porcine Epidemic Diarrhea Virus
MKSLNYFWLFLPVLSTLSLPQDVTRCQSTINFRRFFSKFNVQAPAVVLLGGYLPSMNSSSWYCGTGLETASGVHGIFLSYIDAGQGFEIGISQEPFDPSGYQLYLHKATNGNHNAIARLRICQFPDNKTLGPTVNDVTTGRNCLFNKAIPAYMQDGKNIVVGITWDNDRVTVFADKIYHFYLKNDWSRVATRCYNKRSCAMQYVYTPTYYMLNVTSAGEDGIYYEPCTANCSGYAANVFATDSNGHIPEGFSFNNWFLLSNDSTLLHGKVVSNQPLLVNCLLAIPKIYGLGQFFSFNQTMDGVCNGAAAQRAPEALRFNINDTSVILAEGSIVLHTALGTNLSFVCSNSSDPHLATFAIPLGATQVPYYCFLKVDTYNSTVYKFLAVLPPTVREIVITKYGDVYVNGFGYLHLGLLDAVTINFTGHGTDDDVSGFWTIASTNFVDALIEVQGTAIQRILYCDDPVSQLKCSQVAFDLDDGFYPISSRNLLSHEQPISFVTLPSFNDHSFVNITVSASFGGHSGANLIASDTTINGFSSFCVDTRQFTISLFYNVTNSYGYVSKSQDSNCPFTLQSVNDYLSFSKFCVSTSLLASACTIDLFGYPEFGSGVKFTSLYFQFTKGELITGTPKPLEGVTDVSSMTLDVCTKYTIYGFKGEGIITLTNSSFLAGVYYTSDSGQLLAFKNVTSGAVYSVTPCSFSEQAAYVDDDIVGVISSLSSSTFNSTRELPGFFYHSNDGSNCTEPVLVYSNIGVCKSGSIGYVPSQSGQVKIAPTVTGNISIPTNFSMSIRTEYLQLYNTPVSVDCATYVCNGNSRCKQLLTQYTAACKTIESALQLSARLESVEVNSMLTISEEALQLATISSFNGDGYNFTNVLGVSVYDPASGRVVQKRSFIEDLLFNKVVTNGLGTVDEDYKRCSNGRSVADLVCAQYYSGVMVLPGVVDAEKLHMYSASLIGGMVLGGFTSAAALPFSHAVQARLNYLALQTDVLQRNQQLLAESFNSAIGNITPAFESVKEAISQTSKGLNTVAHALTKVQEVVNSQGAALTQLTVQLQHNFQAISSSIDDIYSRLDILSADVQVDRLITGRLSALNAFVAQTLTKYTEVQASRKLAQQKVNECVKSQSQRYGFCGGDGEHIFSLVQAAPQGLLFLHTVLVPSDFVDVIAIAGLCVNDEIALTLREPGLVLFTHELQNHTATEYFVSSRRMFEPRKPTVSDFVQIESCVVTYVNLTRDQLPDVIPDYIDVNKTLDEILASLPNRTGPSLPLDVFNATYLNLTGEIADLEQRSESLRNTTEELQSLIYNINNTLVDLEWLNRVETYIKWPWWVWLIIFIVLIFVVSLLVFCCISTGCCGCCGCCCACFSGCCRGPRLQPYEVFEKVHVQ

SEQ ID NO: 25 - protein, 143 aa, Porcine Epidemic Diarrhea Virus; identical to SEQ ID NO: 19

SEQ ID NO: 26 - protein, 76 aa, Porcine Epidemic Diarrhea Virus; identical to SEQ ID NO: 20

SEQ ID NO: 27 - protein, 226 aa, Porcine Epidemic Diarrhea Virus; identical to SEQ ID NO: 21

SEQ ID NO: 28 - protein, 441 aa, Porcine Epidemic Diarrhea Virus; identical to SEQ ID NO: 22

SEQ ID NO: 29 - protein, 6781 aa, Porcine Epidemic Diarrhea Virus
MASNHVTLAFANDAEISAFGFCTASEAVSYYSEAAASGFMQCRFVSFDLADTVEGLLPEDYVMVVVGTTKLSAYVDTFGSRPKNICGWLLFSNCNYFLEELELTFGRRGGNIVPVDQYMCGADGKPVLQESEWEYTDFFADSEDGQLNIAGITYVKAWIVERSDVSYASQNLTSIKSITYCSTYEHTFPDGTAMKVARTPKIKKTVVLSEPLATIYREIGSPFVDNGSDARSIIKRPVFLHAFVKCKCGSYHWTVGDWTSYVSTCCGFKCKPVLVASCSATPGSVVVTRAGAGTGVKYYNNMFLRHVADIDGLAFWRILKVQSKDDLACSGKFLEHHEEGFTDPCYFLNDSSIATKLKFDILSGKFSDEVKQAIFAGHVVVGSALVDIVDDALGQPWFIRKLGDLASAAWEQLKAVVRGLNLLSDEVVLFGKRLSCATLSIVNGVFEFIAEVPEKLAAAVTVFVNFLNELFESACDCLKVGGKTFNKVGSYVLFDNALVKLVKAKVRGPRQAGVCEVRYTSLVIGSTTKVVSKRVENANVNLVVVDEDATPNTTGRTVVVDGLAFFESDGFYRHLADADVVIEHPVYKSACELKPVFECDPIPDFPMPVAASVAELCVQTDLLLKNYNTPYKTYSCVVRGDKCCITCTLHFTAPSYMEAAANFVDLCTKNIGTAGFHEFYITAHEQQDLQGFVTTCCTMSGFECFMPIIPQCPAVLEEIDGGSIWRSFITGLNTMWDFCKHLKVSFGLDGIVVTVARKFKRLGALLAEMYNTYLSTVVENLVLAGVSFKYYATSVPKIVLGCCFHSVKSVLASAFQIPVQAGVEKFKVFLNCVHPVVPRVIETSFVELEETTFKPPALNGSIAIVDGFAFYYDGTLYYPTDGNSVVPICFKKKGGGDVKFSDEVSVKTIDPVYKVSLEFEFESETIMAVLNKAVGNCIKVTGGWDDVVEYINVAIEVLKDHIDVPKYYIYDEEGGTDPNLPVMVSQWPLNDDTISQDLLDVEVVTDAPVDFEGDEVDSSDPDKVADVANSEPEDDGLNVAPETNVESEVEEVAATLSFIKDTPSTVTKDPFAFDFASYGGLKVLRQSHNNCWVTSTLVQLQLLGIVDDPAMELFSAGRVGPMVRKCYESQKAILGSLGDVSACLESLTKDLHTLKITCSVVCGCGTGERIYDGCAFRMTPTLEPFPYGACAQCAQVLMHTFKSIVGTGIFCRDTTALSLDSLVVKPLCAAAFIGKDSGHYVTNFYDAAMAIDGYGRHQIKYDTLNTICVKDVNWTAPFVPDVEPVLEPVVKPFYSYKNVDFYQGDFSDLVKLPCDFVVNAANENLSHGGGIAKAIDVYTRGMLQKCSNDYIKAHGPIKVGRGVMLEALGLKVFNVVGPRKGKHAPELLVKAYKSVFANSGVALTPLISVGIFSVPLEESLSAFLACVGDRHCKCFCYSDKEREAIINYMDGLVDAIFKDALVDTTPVQEDVQQVSQKPVLPNFEPFRIEGAHAFYECNPEGLMSLGADKLVLFTNSNLDFCSVGKCLNNVTGGALLEAINVFKKSNKTVPAGNCVTFECADMISITMVVLPSDGDANYDKNYARAVVKVSKLKGKLLLAVGDAMLYSKLSHLSVLGFVSTPDDVERFYANKSVVIKVTEDTRSVKTVKVESTVTYGQQIGPCLVNDTVVTDNKPVVADVVAKVVPSANWDSHYGFDKAGEFHMLDHTGFAFPSEVVNGRRVLKTTDNNCWVNVTCLQLQFARFRFKSAGLQAMWESYCTGDVAMFVHWLYWLTGVDKGQPSDSENALNMLSKYIVPAGSVTIERVTHDGCCCSKRVVTAPVVNASVLKLGVEDGLCPHGLNYIDKVVVVKGTTIVVNVGKPVVAPSHLFLKGVSYTTFLDNGNGVAGHYTVFDHDTGMVHDGDVFVPGDLNVSPVTNVVVSEQTAVVIKDPVKKVELDATKLLDTMNYASERFFSFGDFMSRNLITVFLYILSILGLCFRAFRKRDVKVLAGVPQRTGIILRKSVRYNAKALGVFFKLKLYWFKVLGKFSLGIYALYALLFMTIRFTPIGGPVCDDVVAGYANSSFDKNEYCNSVICKVCLYGYQELSDFSHTQVVWQHLRDPLIGNVMPFFYLAFLAIFGGVYVKAITLYFIFQYLNILGVFLGLQQSIWFLQLVPFDVFGDEIVVFFIVTRVLMFLKHVFLGCDKASCVACSKSARLKRVPVQTIFQGTSKSFYVHANGGSKFCKKHNFFCLNCDSYGPGCTFINDVIATEVGNVVKLNVQPTGPATILIDKVEFSNGFYYLYSGDTFWKYNFDITDNKYTCKESLKNCSIITDFIVFNNNGSNVNQVKNACVYFSQMLCKPVKLVDSALLASLSVDFGASLHSAFVSVLSNSFGKDLSSCNDMQDCKSTLGFDDVPLDTFNAAVAEAHRYDVLLTDMSFNNFTTSYAKPEEKLPVHDIATCMRVGAKIVNHNVLVKDSIPVVWLVRDFIALSEETRKYIIRTTKVKGITFMLTFNDCRMHTTIPTVCIANKKGAGLPSFSKVKKFFWFLCLFIVAVFFALSFFDFSTQVSSDSDYDFKYIESGQLKTFDNPLSCVHNVFSNFDQWHDAKFGFTPVNNPSCPIVVGVSDEARTVPGIPAGVYLAGKTLVFAINTIFGTSGLCFDASGVADKGACIFNSACTTLSGLGGTAVYCYKNGLVEGAKLYSELAPHSYYKMVDGNTVSLPEIISRGFGIRTIRTKAMTYCRVGQCVQSAEGVCFGADRFFVYNAESGSDFVCGTGLFTLLMNVISVFSKTVPVTVLSGQILFNCIIAFAAVAVCFLFTKFKRMFGDMSVGVFTVGACTLLNNVSYIVTQNTLGMLGYATLYFLCTKGVRYMWIWHLGFLISYILIAPWWVLMVYAFSAIFEFMPNLFKLKVSTQLFEGDKFVGSFENAAAGTFVLDMHAYERLANSISTEKLRQYASTYNKYKYYSGSASEADYRLACFAHLAKAMMDYASNHNDTLYTPPTVSYNSTLQAGLRKMAQPSGVVEKCIVRVCYGNMALNGLWLGDTVICPRHVIASSTTSTIDYDYALSVLRLHNFSISSGNVFLGVVGVTMRGALLQIKVNQNNVHTPKYTYRTVRPGESFNILACYDGSAAGVYGVNMRSNYTIRGSFINGACGSPGYNINNGTVEFCYLHQLELGSGCHVGSDLDGVMYGGYEDQPTLQVEGASSLFTENVLAFLYAALINGSTWWLSSSRIAVDRFNEWAVHNGMTTVVNTDCFSILAAKTGVDVQRLLASIQSLHKNFGGKQILGYTSLTDEFTTGEVIRQMYGVNLQSGYVSRACRNVLLVGSFLTFFWSELVSYTKFFWVNPGYVTPMFACLSLLSSLLMFTLKHKTLFFQVFLIPALIVTSCINLAFDVEVYNYLAEHFDYHVSLMGFNAQGLVNIFVCFVVTILHGTYTWRFFNTPVSSVTYVVALLTAAYNYFYASDILSCAMTLFASVTGNWFVGAVCYKAAVYMALRFPTFVAIFGDIKSVMFCYLVLGYFTCCFYGILYWFNRFFKVSVGVYDYTVSAAEFKYMVANGLRAPTGTLDSLLLSAKLIGIGGERNIKISSVQSKLTDIKCSNVVLLGCLSSMNVSANSTEWAYCVDLHNKINLCNDPEKAQEMLLALLAFFLSKNSAFGLDDLLESYFNDNSMLQSVASTYVGLPSYVIYENARQQYEDAVNNGSPPQLVKQLRHAMNVAKSEFDREASTQRKLDRMAEQAAAQMYKEARAVNRKSKVVSAMHSLLFGMLRRLDMSSVDTILNLAKDGVVPLSVIPAVSATKLNIVTSDIDSYNRIQREGCVHYAGTIWNIIDIKDNDGKVVHVKEVTAQNAESLSWPLVLGCERIVKLQNNEIIPGKLKQRSIKAEGDGIVGEGKALYNNEGGRTFMYAFISDKPDLRVVKWEFDGGCNTIELEPPRKFLVDSPNGAQIKYLYFVRNLNTLRRGAVLGYIGATVRLQAGKQTEQAINSSLLTLCAFAVDPAKTYIDAVKSGHKPVGNCVKMLANGSGNGQAVTNGVEASTNQDSYGGASVCLYCRAHVEHPSMDGFCRLKGKYVQVPLGTVDPIRFVLENDVCKVCGCWLANGCTCDRSIMQSTDMAYLNRVRGSSAARLEPCNGTDTQHVYRAFDIYNKDVACLGKFLKVNCVRLKNLDKHDAFYVVKRCTKSAMEHEQSIYSRLEKCGAVAEHDFFTWKDGRAIYGNVCRKDLTEYTMMDLCYALRNFDENNCDVLKSILIKVGACEESYFNNKVWFDPVENEDIHRVYALLGTIVSRAMLKCVKFCDAMVEQGIVGVVTLDNQDLNGDFYDFGDFTCSIKGMGIPICTSYYSYMMPVMGMTNCLASECFVKSDIFGEDFKSYDLLEYDFTEHKTALFNKYFKYWGLQYHPNCVDCSDEQCIVHCANFNTLFSTTIPITAFGPLCRKCWIDGVPLVTTAGYHFKQLGIVWNNDLNLHSSRLSINELLQFCSDPALLIASSPALVDQRTVCFSVAALGTGMTNQTVKPGHFNKEFYDFLLEQGFFSEGSELTLKHFFFAQKGDAAVKDFDYYRYNRPTVLDICQARVVYQIVQRYFDIYEGGCITAKEVVVTNLNKSAGYPLNKFGKAGLYYESLSYEEQDELYAYTKRNILPTMTQLNLKYAISGKERARTVGGVSLLSTMTTRQYHQKHLKSIVNTRGASVVIGTTKFYGGWDNMLKNLIDGVENPCLMGWDYPKCDRALPNMIRMISAMILGSKHTTCCSSTDRFFRLCNELAQVLTEVVYSNGGFYLKPGGTTSGDATTAYANSVFNIFQAVSANVNKLLSVDSNVCHNLEVKQLQRKLYECCYRSTTVDDQFVVEYYGYLRKHFSMMILSDDGVVCYNNDYASLGYVADLNAFKAVLYYQNNVFMSASKCWIEPDINKGPHEFCSQHTMQIVDKDGTYYLPYPDPSRILSAGVFVDDVVKTDAVVLLERYVSLAIDAYPLSKHENPEYKKVFYVLLDWVKHLYKTLNAGVLESFSVTLLEDSTAKFWDESFYANMYEKSAVLQSAGLCVVCGSQTVLRCGDCLRRPMLCTKCAYDHVIGTTHKFILAITPYVCCASDCGVNDVTKLYLGGLSYWCHDHKPRLAFPLCSAGNVFGLYKNSATGSPDVEDFNRIATSDWTDVSDYRLANDVKDSLRLFAAETIKAKEESVKSSYACATLHEVVGPKELLLKWEVGRPKPPLNRNSVFTCYHITKNTKFQIGEFVFEKAEYDNDAVTYKTTATTKLVPGMVFVLTSHNVQPLRAPTIANQERYSTIHKLHPAFNIPEAYSSLVPYYQLIGKQKITTIQGPPGSGKSHCVIGLGLYYPGARIVFTACSHAAVDSLCVKASTAYSNDKCSRIIPQRARVECYDGFKSNNTSAQYLFSTVNALPECNADIVVVDEVSMCTNYDLSVINQRISYRHVVYVGDPQQLPAPRVMISRGTLEPKDYNVVTQRMCALKPDVFLHKCYRCPAEIVRTVSEMVYENQFIPVHPDSKQCFKIFCKGNVQVDNGSSINRRQLDVVRMFLAKNPRWSKAVFISPYNSQNYVASRMLGLQIQTVDSSQGSEYDYVIYTQTSDTAHACNVNRFNVAITRAKKGILCIMCDRSLFDVLKFFELKLSDLQANEGCGLFKDCSRGDDLLPPSHANTFMSLADNFKTDQDLAVQIGVNGPIKYEHVISFMGFRFDINIPNHHTLFCTRDFAMRNVRGWLGFDVEGAHVVGSNVGTNVPLQLGFSNGVDFVVRPEGCVVTESGDYIKPVRARAPPGEQFAHLLPLLKRGQPWDVVRKRIVQMCSDYLANLSDILIFVLWAGGLELTTMRYFVKIGPSKSCDCGKVATCYNSALHTYCCFKHALGCDYLYNPYCIDIQQWGYKGSLSLNHHEHCNVHRNEHVASGDAIMTRCLAIHDCFVKNVDWSITYPFIGNEAVINKSGRIVQSHTMRSVLKLYNPKAIYDIGNPKGIRCAVTDAKWFCFDKNPTNSNVKTLEYDYITHGQFDGLCLFWNCNVDMYPEFSVVCRFDTRCRSPLNLEGCNGGSLYVNNHAFHTPAFDKRAFAKLKPMPFFFYDDTECDKLQDSINYVPLRASNCITKCNVGGAVCSKHCAMYHSYVNAYNTFTSAGFTIWVPTSFDTYNLWQTFSNNLQGLENIAFNVVKKGSFVGAEGELPVAVVNDKVLVRDGTVDTLVFTNKTSLPTNVAFELYAKRKVGLTPPITILRNLGVVCTSKCVIWDYEAERPLTTFTKDVCKYTDFEGDVCTLFDNSIVGSLERFSMTQNAVLMSLTAVKKLTGIKLTYGYLNGVPVNTHEDKPFTWYIYTRKNGKFEDHPDGYFTQGRTTADFSPRSDMEKDFLSMDMGLFINKYGLEDYGFEHVVYGDVSKTTLGGLHLLISQVRLACMGVLKIDEFVSSNDSTLKSCTVTYADNPSSKMVCTYMDLLLDDFVSILKSLDLSVVSKVHEVMVDCKMWRWMLWCKDHKLQTFYPQLQASEWKCGYSMPSIYKIQRMCLEPCNLYNYGAGIKLPDGIMFNVVKYTQLCQYLNSTTMCVPHHMRVLHLGAGSDKGVAPGTAVLRRWLPLDAIIVDNDSVDYVSDADYSVTGDCSTLYLSDKFDLVISDMYDGKIKSCDGENVSKEGFFPYINGVITEKLALGGTVAIKVTEFSWNKKLYELIQKFEYWTMFCTSVNTSSSEAFLIGVHYLGDFASGAVIDGNTMHANYIFWRNSTIMTMSYNSVLDLSKFNCKHKATVVINLKDSSISDVVLGLLKNGKLLVRNNDAICGFSNHLVNVNK

SEQ ID NO: 30 - protein, 1383 aa, Porcine Epidemic Diarrhea Virus; identical to SEQ ID NO: 24

SEQ ID NO: 31 - protein, 143 aa, Porcine Epidemic Diarrhea Virus; identical to SEQ ID NO: 19

SEQ ID NO: 32 - protein, 76 aa, Porcine Epidemic Diarrhea Virus; identical to SEQ ID NO: 20

SEQ ID NO: 33 - protein, 226 aa, Porcine Epidemic Diarrhea Virus; identical to SEQ ID NO: 21

SEQ ID NO: 34 - protein, 441 aa, Porcine Epidemic Diarrhea Virus; identical to SEQ ID NO: 22

SEQ ID NO: 35 - DNA, 28024 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgttttgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggcctttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaataaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttttgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactattaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataactccagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagctttgacggcaaatccattgtgattttagaaggtggtgaccattacatcacttttggcaactcctttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatcacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 36 - DNA, 28025 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgttttgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatatggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaataaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttttgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactattaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagccatgctgttcaagctagactcaattatcttgctctacagacggatgttctacagcggaaccagcaattgcttgctgagtcttttaactctgctattggtaatataactccagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagctttgacggcaaatccattgtgattttagaaggtggtgaccattacatcacttttggcaactcctttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatcacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 37 - DNA, 28025 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgttttgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgacccccaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatatggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaataaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttttgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactattaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagccatgctgttcaagctagactcaattatcttgctctacagacggatgttctacagcggaaccagcaattgcttgctgagtcttttaactctgctattggtaatataactccagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagctttgacggcaaatccattgtgattttagaaggtggtgaccattacatcacttttggcaactcctttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatcacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 38 - DNA, 28025 bp, Porcine Epidemic Diarrhea Virus; identical to SEQ ID NO: 15

SEQ ID NO: 39 - DNA, 27954 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatctgatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagttttcgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgtcgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctatgcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagtccttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcgagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctttctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgttggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtttatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaacaaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgattcaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtagcaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtctactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgcttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgttccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcacgtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggcgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggacacctatgtcaatttgactagagaccaactaccagatgtaatcccagattacatcgatgttaacaaaacacttgatgagattttagcttctctgcccaatagaactggtccaagtcttcctttagatgtttttaatgccatttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatagtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttatgacggcaaatccattgtgattttagaaggtggtgaccattacatcacttttggcaactcctttgttgcttttgttagtagcattgacttgtatctagctatacaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagttttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtattggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaatagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 40 - protein, 6781 aa, Porcine Epidemic Diarrhea Virus
MASNHVTLAFANDAEISAFGFCTASEAVSYYSEAAASGFMQCRFVSFDLADTVEGLLPEDYVMVVVGTTKLSAYVDTFGSRPKNICGWLLFSNCNYFLEELELTFGRRGGNIVPVDQYMCGADGKPVLQESEWEYTDFFADSEDGQLNIAGITYVKAWIVERSDVSYASQNLTSIKSITYCSTYEHTFPDGTAMKVARTPKIKKTVVLSEPLATIYREIGSPFVDNGSDARSIIKRPVFLHAFVKCKCGSYHWTVGDWTSYVSTCCGFKCKPVLVASCSATPGSVVVTRAGAGTGVKYYNNMFLRHVADIDGLAFWRILKVQSKDDLACSGKFLEHHEEGFTDPCYFLNDSSIATKLKFDILSGKFSDEVKQAIFAGHVVVGSALVDIVDDALGQPWFIRKLGDLASAAWEQLKAVVRGLNLLSDEVVLFGKRLSCATLSIVNGVFEFIAEVPEKLAAAVTVFVNFLNELFESACDCLKVGGKTFNKVGSYVLFDNALVKLVKAKVRGPRQAGVCEVRYTSLVIGSTTKVVSKRVENANVNLVVVDEDATLNTTGRTVVVDGLAFFESDGFYRHLADADVVIEHPVYKSACELKPVFECDPIPDFPMPVAASVAELCVQTDLLLKNYNTPYKTYSCVVRGDKCCITCTLHFTAPSYMEAAANFVDLCTKNIGTAGFHEFYITAHEQQDLQGFVTTCCTMSGFECFMPIIPQCPAVLEEIDGGSIWRSFITGLNTMWDFCKHLKVSFGLDGIVVTVARKFKRLGALLAEMYNTYLSTVVENLVLAGVSFKYYATSVPKIVLGCCFHSVKSVLASAFQIPVQAGVEKFKVFLNCVHPVVPRVIETSFVELEETTFKPPALNGSIAIVDGFAFYYDGTLYYPTDGNSVVPICFKKKGGGDVKFSDEVSVKTIDPVYKVSLEFEFESETIMAVLNKAVGNCIKVTGGWDDVVEYINVAIEVLKDHIDVPKYYIYDEEGGTDPNLPVMVSQWPLNDDTISQDLLDVEVVTDAPVDFEGDEVDSSDPDKVADVANSEPEDDGLNVAPETNVESEVEEVAATLSFIKDTPSTVTKDPFAFDFASYGGLKVLRQSHNNCWVTSTLVQLQLLGIVDDPAMELFSAGRVGPMVRKCYESQKAILGSLGDVSACLESLTKDLHTLKITCSVVCGCGTGERIYDGCAFRMTPTLEPFPYGACAQCAQVLMHTFKSIVGTGIFCRDTTALSLDSLVVKPLCAAAFIGKDSGHYVTNFYDAAMAIDGYGRHQIKYDTLNTICVKDVNWTAPFVPDVEPVLEPVVKPFYSYKNVDFYQGDFSDLVKLPCDFVVNAANENLSHGGGIAKAIDVYTRGMLQKCSNDYIKAHGPIKVGRGVMLEALGLKVFNVVGPRKGKHAPELLVKAYKSVFANSGVALTPLISVGIFSVPLEESLSAFLACVGDRHCKCFCYSDKEREAIINYMDGLVDAIFKDALVDTTPVQEDVQQVSQKPVLPNFEPFRIEGAHAFYECNPEGLMSLGADKLVLFTNSNLDFCSVGKCLNNVTGGALLEAINVFKKSNKTVPAGNCVTFECADMISITMVVLPSDGDANYDKNYARAVVKVSMLKGKLLLAVGDAMLYSKLSHLSVLGFVSTPDDVERFYANKSVVIKVTEDTRSVKTVKVESTVTYGQQIGPCLVNDTVVTDNKPVVADVVAKVVPSANWDSHYGFDKAGEFHMLDHTGFAFPSEVVNGRRVLKTTDNNCWVNVTCLQLQFARFRFKSAGLQAMWESYCTGDVAMFVHWLYWLTGVDKGQPSDSENALNMLSKYIVPAGSVTIERVTHDGCCCSKRVVTAPVVNASVLKLGVEDGLCPHGLNYIDKVVVVKGTTIVVNVGKPVVAPSHLFLKGVSYTTFLDNGNGVAGHYTVFDHDTGMVHDGDVFVPGDLNVSPVTNVVVSEQTAVVIKDPVKKVELDATKLLDTMNYASERFFSFGDFMSRNLITVFLYILSILGLCFRAFRKRDVKVLAGVPQRTGIILRKSVRYNAKALGVFFKLKLYWFKVLGKFSLGIYALYALLFMTIRFTPIGGPVCDDVVAGYANSSFDKNEYCNSVICKVCLYGYQELSDFSHTQVVWQHLRDPLIGNVMPFFYLAFLAIFGGVYVKAITLYFIFQYLNILGVFLGLQQSIWFLQLVPFDVFGDEIVVFFIVTRVLMFLKHVFLGCDKASCVACSKSARLKRVPVQTIFQGTSKSFYVHANGGSKFCKKHNFFCLNCDSYGPGCTFINDVIATEVGNVVKLNVQPTGPATILIDKVEFSNGFYYLYSGDTFWKYNFDITDNKYTCKESLKNCSIITDFIVFNNNGSNVNQVKNACVYFSQMLCKPVKLVDSALLASLSVDFGASLHSAFVSVLSNSFGKDLSSCNDMQDCKSTLGFDDVPLDTFNAAVAEAHRYDVLLTDMSFNNFTTSYAKPEEKLPVHDIATCMRVGAKIVNHNVLVKDSIPVVWLVRDFIALSEETRKYIIRTTKVKGITFMLTFNDCRMHTTIPTVCIANKKGAGLPSFSKVKKFFWFLCLFIVAVFFALSFFDFSTQVSSDSDYDFKYIESGQLKTFDNPLSCVHNVFSNFDQWHDAKFGFTPVNNPSCPIVVGVSDEARTVPGIPAGVYLAGKTLVFAINTIFGTSGLCFDASGVADKGACIFNSACTTLSGLGGTAVYCYKNGLVEGAKLYSELAPHSYYKMVDGNTVSLPEIISRGFGIRTIRTKAMTYCRVGQCVQSAEGVCFGADRFFVYNAESGSDFVCGTGLFTLLMNVISVFSKTVPVTVLSGQILFNCIIAFAAVAVCFLFTKFKRMFGDMSVGVFTVGACTLLNNVSYIVTQNTLGMLGYATLYFLCTKGVRYMWIWHLGFLISYILIAPWWVLMVYAFSAIFEFMPNLFKLKVSTQLFEGDKFVGSFENAAAGTFVLDMHAYERLANSISTEKLRQYASTYNKYKYYSGSASEADYRLACFAHLAKAMMDYASNHNDTLYTPPTVSYNSTLQAGLRKMAQPSGVVEKCIVRVCYGNMALNGLWLGDTVICPRHVIASSTTSTIDYDYALSVLRLHNFSISSGNVFLGVVGVTMRGALLQIKVNQNNVHTPKYTYRTVRPGESFNILACYDGSAAGVYGVNMRSNYTIRGSFINGACGSPGYNINNGTVEFCYLHQLELGSGCHVGSDLDGVMYGGYEDQPTLQVEGASSLFTENVLAFLYAALINGSTWWLSSSRIAVDRFNEWAVHNGMTTVVNTDCFSILAAKTGVDVQRLLASIQSLHKNFGGKQILGYTSLTDEFTTGEVIRQMYGVNLQSGYVSRACRNVLLVGSFLTFFWSELVSYTKFFWVNPGYVTPMFACLSLLSSLLMFTLKHKTLFFQVFLIPALIVTSCINLAFDVEVYNYLAEHFDYHVSLMGFNAQGLVNIFVCFVVTILHGTYTWRFFNTPVSSVTYVVALLTAAYNYFYASDILSCAMTLFASVTGNWFVGAVCYKAAVYMALRFPTFVAIFGDIKSVMFCYLVLGYFTCCFYGILYWFNRFFKVSVGVYDYTVSAAEFKYMVANGLRAPTGTLDSLLLSAKLIGIGGERNIKISSVQSKLTDIKCSNVVLLGCLSSMNVSANSTEWAYCVDLHNKINLCNDPEKAQEMLLALLAFFLSKNSAFGLDDLLESYFNDNSMLQSVASTYVGLPSYVIYENARQQYEDAVNNGSPPQLVKQLRHAMNVAKSEFDREASTQRKLDRMAEQAAAQMYKEARAVNRKSKVVSAMHSLLFGMLRRLDMSSVDTILNLAKDGVVPLSVIPAVSATKLNIVTSDIDSYNRIQREGCVHYAGTIWNIIDIKDNDGKVVHVKEVTAQNAESLSWPLVLGCERIVKLQNNEIIPGKLKQRSIKAEGDGIVGEGKALYNNEGGRTFMYAFISDKPDLRVVKWEFDGGCNTIELEPPRKFLVDSPNGAQIKYLYFVRNLNTLRRGAVLGYIGATVRLQAGKQTEQAINSSLLTLCAFAVDPAKTYIDAVKSGHKPVGNCVKMLANGSGNGQAVTNGVEASTNQDSYGGASVCLYCRAHVEHPSMDGFCRLKGKYVQVPLGTVDPIRFVLENDVCKVCGCWLANGCTCDRSIMQSTDMAYLNRVRGSSAARLEPCNGTDTQHVYRAFDIYNKDVACLGKFLKVNCVRLKNLDKHDAFYVVKRCTKSAMEHEQSIYSRLEKCGAVAEHDFFTWKDGRAIYGNVCRKDLTEYTMMDLCYALRNFDENNCDVLKSILIKVGACEESYFNNKVWFDPVENEDIHRVYALLGTIVSRAMLKCVKFCDAMVEQGIVGVVTLDNQDLNGDFYDFGDFTCSIKGMGIPICTSYYSYMMPVMGMTNCLASECFVKSDIFGEDFKSYDLLEYDFTEHKTALFNKYFKYWGLQYHPNCVDCSDEQCIVHCANFNTLFSTTIPITAFGPLCRKCWIDGVPLVTTAGYHFKQLGIVWNNDLNLHSSRLSINELLQFCSDPALLIASSPALVDQRTVCFSVAALGTGMTNQTVKPGHFNKEFYDFLLEQGFFSEGSELTLKHFFFAQKGDAAVKDFDYYRYNRPTVLDICQARVVYQIVQRYFDIYEGGCITAKEVVVTNLNKSAGYPLNKFGKAGLYYESLSYEEQDELYAYTKRNILPTMTQLNLKYAISGKERARTVGGVSLLSTMTTRQYHQKHLKSIVNTRGASVVIGTTKFYGGWDNMLKNLIDGVENPCLMGWDYPKCDRALPNMIRMISAMILGSKHTTCCSSTDRFFRLCNELAQVLTEVVYSNGGFYLKPGGTTSGDATTAYANSVFNIFQAVSANVNKLLSVDSNVCHNLEVKQLQRKLYECCYRSTTVDDQFVVEYYGYLRKHFSMMILSDDGVVCYNNDYASLGYVADLNAFKAVLYYQNNVFMSASKCWIEPDINKGPHEFCSQHTMQIVDKDGTYYLPYPDPSRILSAGVFVDDVVKTDAVVLLERYVSLAIDAYPLSKHENPEYKKVFYVLLDWVKHLYKTLNAGVLESFSVTLLEDSTAKFWDESFYANMYEKSAVLQSAGLCVVCGSQTVLRCGDCLRRPMLCTKCAYDHVIGTTHKFILAITPYVCCASDCGVNDSTKLYLGGLSYWCHDHKPRLAFPLCSAGNVFGLYKNSATGSPDVEDFNRIATSDWTDVSDYRLANDVKDSLRLFAAETIKAKEESVKSSYACATLHEVVGPKELLLKWEVGRPKPPLNRNSVFTCYHITKNTKFQIGEFVFEKAEYDNDAVTYKTTATTKLVPGMVFVLTSHNVQPLRAPTIANQERYSTIHKLHPAFNIPEAYSSLVPYYQLIGKQKITTIQGPPGSGKSHCVIGLGLYYPGARIVFTACSHAAVDSLCVKASTAYSNDKCSRIIPQRARVECYDGFKSNNTSAQYLFSTVNALPECNADIVVVDEVSMCTNYDLSVINQRISYRHVVYVGDPQQLPAPRVMISRGTLEPKDYNVVTQRMCALKPDVFLHKCYRCPAEIVRTVSEMVYENQFIPVHPDSKQCFKIFCKGNVQVDNGSSINRRQLDVVRMFLAKNPRWSKAVFISPYNSQNYVASRMLGLQIQTVDSSQGSEYDYVIYTQTSDTAHACNVNRFNVAITRAKKGILCIMCDRSLFDVLKFFELKLSDLQANEGCGLFKDCSRGDDLLPPSHANTFMSLADNFKTDQDLAVQIGVNGPIKYEHVISFMGFRFDINIPNHHTLFCTRDFAMRNVRGWLGFDVEGAHVVGSNVGTNVPLQLGFSNGVDFVVRPEGCVVTESGDYIKPVRARAPPGEQFAHLLPLLKRGQPWDVVRKRIVQMCSDYLANLSDILIFVLWAGGLELTTMRYFVKIGPSKSCDCGKVATCYNSALHTYCCFKHALGCDYLYNPYCIDIQQWGYKGSLSLNHHEHCNVHRNEHVASGDAIMTRCLAIHDCFVKNVDWSITYPFIGNEAVINKSGRIVQSHTMRSVLKLYNPKAIYDIGNPKGIRCAVTDAKWFCFDKNPTNSNVKTLEYDYITHGQFDGLCLFWNCNVDMYPEFSVVCRFDTRCRSPLNLEGCNGGSLYVNNHAFHTPAFDKRAFAKLKPMPFFFYDDTECDKLQDSINYVPLRASNCITKCNVGGAVCSKHCAMYHSYVNAYNTFTSAGFTIWVPTSFDTYNLWQTFSSNLQGLENIAFNVVKKGSFVGAEGELPVAVVNDKVLVRDGTVDTLVFTNKTSLPTNVAFELYAKRKVGLTPPITILRNLGVVCTSKCVIWDYEAERPLTTFTKDVCKYTDFEGDVCTLFDNSIVGSLERFSMTQNAVLMSLTAVKKLTGIKLTYGYLNGVPVNTHEDKPFTWYIYTRKNGKFEDHPDGYFTQGRTTADFSPRSDMEKDFLSMDMGLFINKYGLEDYGFEHVVYGDVSKTTLGGLHLLISQVRLACMGVLKIDEFVSSNDSTLKSCTVTYADNPSSKMVCTYMDLLLDDFVSILKSLDLSVVSKVHEVMVDCKMWRWMLWCKDHKLQTFYPQLQASEWKCGYSMPSIYKIQRMCLEPCNLYNYGAGIKLPDGIMFNVVKYTQLCQYLNSTTMCVPHHMRVLHLGAGSDKGVAPGTAVLRRWLPLDAIIVDNDSVDYVSDADYSVTGDCSTLYLSDKFDLVISDMYDGKIKSCDGENVSKEGFFPYINGVITEKLALGGTVAIKVTEFSWNKKLYELIQKFEYWTMFCTSVNTSSSEAFLIGVHYLGDFASGAVIDGNTMHANYIFWRNSTIMTMSYNSVLDLSKFNCKHKATVVINLKDSSISDVVLGLLKNGKLLVRNNDAICGFSNHLVNVNK

SEQ ID NO: 41 - protein, 1383 aa, Porcine Epidemic Diarrhea Virus
MKSLNYFWLFLPVLSTLSLPQDVTRCQSTINFRRFFSKFNVQAPAVVVLGGYLPSMNSSSWYCGTGLETASGVHGIFLSYIDAGQGFEIGISQEPFDPSGYQLYLHKATNGNHNAIARLRICQFPDNKTLGPTVNDVTTGRNCLFNKAIPAYMQDGKNIVVGITWDNDRVTVFADKIYHFYLKNDWSRVATRCYNKRSCAMQYVYTPTYYMLNVTSAGEDGIYYEPCTANCSGYAANVFATDSNGHIPEGFSFNNWFLLSNDSTLLHGKVVSNQPLLVNCLLAIPKIYGLGQFFSFNQTMDGVCNGAAAQRAPEALRFNINDTSVILAEGSIVLHTALGTNLSFACSNSSDPHLATFAIPLGATQVPYYCFLKVDTYNSTVYKFLAVLPPTVREIVITKYGDVYVNGFGYLHLGLLDAVTINFTGHGTDDDVSGFWTIASTNFVDALIEVQGTAIQRILYCDDPVSQLKCSQVAFDLDDGFYPISSRNLLSHEQPISFVTLPSFNDHSFVNITVSASFGGHSGANLIASDTTINGFSSFCVDTRQFTISLFYNVTNSYGYVSKSQDSNCPFTLQSVNDYLSFSKFCVSTSLLASACTIDLFGYPEFGSGVKFTSLYFQFTKGELITGTPKPLEGVTDVSSMTLDVCTKYTIYGFKGEGIITLTNSSFLAGVYYTSDSGQLLAFKNVTSGAVYSVTPCSFSEQAAYVDDDIVGVISSLSSSTFNSTRELPGFFYHSNDGSNCTEPVLVYSNIGVCKSGSIGYVPSQSGQVKIAPTVTGNISIPTNFSMSIRTEYLQLYNTPVSVDCATYVCNGNSRCKQLLTQYTAACKTIESALQLSARLESVEVNSMLTISEEALQLATISSFNGDGYNFTNVLGVSVYDPARGRVVQKRSFIEDLLFNKVVTNGLGTVDEDYKRCSNGRSVADLVCAQYYSGVMVLPGVVDAEKLHMYSASLIGGMALGGFTSAAALPFSYAVQARLNYLALQTDVLQRNQQLLAESFNSAIGNITSAFESVKEAISQTSKGLNTVAHALTKVQEVVNSQGAALTQLTVQLQHNFQAISSSIDDIYSRLDILSADVQVDRLITGRLSALNAFVAQTLTKYTEVQASRKLAQQKVNECVKSQSQRYGFCGGDGEHIFSLVQAAPQGLLFLHTVLVPSDFVDVIAIAGLCVNDEIALTLREPGLVLFTHELQNHTATEYFVSSRRMFEPRKPTVSDFVQIESCVDTYVNLTRDQLPDVIPDYIDVNKTLDEILASLPNRTGPSLPLDVFNAIYLNLTGEIADLEQRSESLRNTTEELQSLIYNINNTLVDLEWLNRVETYIKWPWWVWLIIFIVLIFVVSLLVFCCISTGCCGCCGCCCACFSGCCRGPRLQPYEVFEKVHVQ

SEQ ID NO: 42 - protein, 7 aa, Porcine Epidemic Diarrhea Virus
MFLGLFQ

SEQ ID NO: 43 - protein, 76 aa, Porcine Epidemic Diarrhea Virus
MLQLVNDNGLVVNVILWLFVLFFLLIISITFVQLVNLCFTCHRLCNSAVYTPIGRLYRVYKFYMQIDPLPSTVIDV

SEQ ID NO: 44 - protein, 226 aa, Porcine Epidemic Diarrhea Virus
MSNGSIPVDEVIQHLRNWNFTWNIILTILLVVLQYGHYKYSAFLYGVKMAILWILWPLVLALSLFDAWASFQVNWVFFAFSILMACITLMLWIMYFVNSIRLWRRTHSWWSFNPETDALLTTSVMGRQVCIPVLGAPTGVTLTLLSGTLLVEGYKVATGVQVSQLPNFVTVAKATTTIVYGRIGRSVNASSGTGWAFYVRSKHGDYSAVSNPSSVLTDSEKVLHLV

SEQ ID NO: 45 - protein, 441 aa, Porcine Epidemic Diarrhea Virus
MASVSFQDRGRKRVPLSLYAPLRVTNDKPLSKVLANNAVPTNKGNKDQQIGYWTEQIRWRMRRGERIEQPSNWHFYYLGTGPHADLRYRTRTEGVFWVAKEGAKTEPTNLGVRKASEKPIIPNFSQQLPSVVEIVEPNTPPTSRANSRSRSRGNGNNRSRSPSNNRGNNQSRGNSQNRGNNQGRGASQNRGGNNNNNNKSRNQSKNRNQSNDRGGVTSRDDLVAAVKDALKSLGIGENPDKLKQQQKPKQERSDSSGKNTPKKNKSRATSKERDLKDIPEWRRIPKGENSVAACFGPRGGFKNFGDAEFVEKGVDASGYAQIASLAPNVAALLFGGNVAVRELADSYEITYNYKMTVPKSDPNVELLVSQVDAFKTGNAKPQRKKEKKNKRETTQQLNEEAIYDDVGVPSDVTHANLEWDTAVDGGDTAVEIINEIFDTGN

SEQ ID NO: 46 - protein, 6781 aa, Porcine Epidemic Diarrhea Virus; identical to SEQ ID NO: 17

SEQ ID NO: 47 - protein, 1383 aa, Porcine Epidemic Diarrhea Virus
MKSLNYFWLFLPVLSTLSLPQDVTRCQSTINFRRFFSKFNVQAPAVVVLGGYLPSMNSSSWYCGTGLETASGVHGIFLSYIDAGQGFEIGISQEPFDPSGYQLYLHKATNGNHNAIARLRICQFPDNKTLGPTVNDVTTGRNCLFNKAIPAYMQDGKNIVVGITWDNDRVTVFADKIYHFYLKNDWSRVATRCYNKRSCAMQYVYTPTYYMLNVTSAGEDGIYYEPCTANCSGYAANVFATDSNGHIPEGFSFNNWFLLSNDSTLLHGKVVSNQPLLVNCLLAIPKIYGLGQFFSFNQTMDGVCNGAAAQRAPEALRFNINDTSVILAEGSIVLHTALGTNLSFACSNSSDPHLATFAIPLGATQVPYYCFLKVDTYNSTVYKFLAVLPPTVREIVITKYGDVYVNGFGYLHLGLLDAVTINFTGHGTDDDVSGFWTIASTNFVDALIEVQGTAIQRILYCDDPVSQLKCSQVAFDLDDGFYPISSRNLLSHEQPISFVTLPSFNDHSFVNITVSASFGGHSGANLIASDTTINGFSSFCVDTRQFTISLFYNVTNSYGYVSKSQDSNCPFTLQSVNDYLSFSKFCVSTSLLASACTIDLFGYPEFGSGVKFTSLYFQFTKGELITGTPKPLEGVTDVSSMTLDVCTKYTIYGFKGEGIITLTNSSFLAGVYYTSDSGQLLAFKNVTSGAVYSVTPCSFSEQAAYVDDDIVGVISSLSSSTFNSTRELPGFFYHSNDGSNCTEPVLVYSNIGVCKSGSIGYVPSQSGQVKIAPTVTGNISIPTNFSMSIRTEYLQLYNTPVSVDCATYVCNGNSRCKQLLTQYTAACKTIESALQLSARLESVEVNSMLTISEEALQLATISSFNGDGYNFTNVLGVSVYDPASGRVVQKRSFIEDLLFNKVVTNGLGTVDEDYKRCSNGRSVADLVCAQYYSGVMVLPGVVDAEKLHMYSASLIGGMVLGGFTSAAALPFSYAVQARLNYLALQTDVLQRNQQLLAESFNSAIGNITSAFESVKEAISQTSKGLNTVAHALTKVQEVVNSQGAALTQLTVQLQHNFQAISSSIDDIYSRLDILSADVQVDRLITGRLSALNAFVAQTLTKYTEVQASRKLAQQKVNECVKSQSQRYGFCGGDGEHIFSLVQAAPQGLLFLHTVLVPSDFVDVIAIAGLCVNDEIALTLREPGLVLFTHELQNHTATEYFVSSRRMFEPRKPTVSDFVQIESCVVTYVNLTRDQLPDVIPDYIDVNKTLDEILASLPNRTGPSLPLDVFNAIYLNLTGEIADLEQRSESLRNTTEELQSLIYNINNTLVDLEWLNRVETYIKWPWWVWLIIFIVLIFVVSLLVFCCISTGCCGCCGCCCACFSGCCRGPRLQPYEVFEKVHVQ

SEQ ID NO: 48 - protein, 224 aa, Porcine Epidemic Diarrhea Virus
MFLGLFQYTIDTVVKDVSKSANLSLDAVQELELNVVPIRQASNVTGFLFTSVFIYFFALFKASSLRRNYIMLAARFAVIVLYCPLLYYCGAFLDATIICCTLIGRLCLVCFYSWRYKNALFIIFNTTTLSFLNGKAAYYDGKSIVILEGGDHYITFGNSFVAFVSSIDLYLAIRGRQEADLQLLRTVELLDGKKLYVFSQHQIVGITNAAFDSIQLDEYATISE

SEQ ID NO: 49 - protein, 76 aa, Porcine Epidemic Diarrhea Virus; identical to SEQ ID NO: 20

SEQ ID NO: 50 - protein, 226 aa, Porcine Epidemic Diarrhea Virus; identical to SEQ ID NO: 21

SEQ ID NO: 51 - protein, 441 aa, Porcine Epidemic Diarrhea Virus; identical to SEQ ID NO: 45

SEQ ID NO: 52 - protein, 6781 aa, Porcine Epidemic Diarrhea Virus
MASNHVTLAFANDAEISAFGFCTASEAVSYYSEAAASGFMQCRFVSFDLADTVEGLLPEDYVMVVVGTTKLSAYVDTFGSRPKNICGWLLFSNCNYFLEELELTFGRRGGNIVPVDQYMCGADGKPVLQESEWEYTDFFADSEDGQLNIAGITYVKAWIVERSDVSYASQNLTSIKSITYCSTYEHTFPDGTAMKVARTPKIKKTVVLSEPLATIYREIGSPFVDNGSDARSIIKRPVFLHAFVKCKCGSYHWTVGDWTSYVSTCCGFKCKPVLVASCSATPGSVVITRAGAGTGVKYYNNMFLRHVADIDGLSFWRILKVQSKDDLACSGKFLEHHEEGFTDPCYFLNDSSIATKLKFDILSGKFSDEVKQAIFAGHVVVGSALVDIVDDALGQPWFIRKLGDLASAAWEQLKAVVRGLNLLSDEVVLFGKRLSCATLSIVNGVFEFIAEVPEKLAAAVTVFVNFLNELFESACDCLKVGGKTFNKVGSYVLFDNALVKLVKAKVRGPRQAGVCEVRYTSLVIGSTTKVVSKRVENANVNLVVVDEDVTLNTTGRTVVVDGLAFFESDGFYRHLADADVVIEHPVYKSACELKPVFECDPIPDFPMPVAASVAELCVQTDLLLKNYNTPYKTYSCVVRGDKCCITCTLHITAPSYMEDAANFVDLCTKNIGTAGFHEFYITAHEQQDLQGFVTTCCTMSGFECFMPIIPQCPAVLEEIDGGSIWRSFITGLNTMWDFCKHLKVSFGLDGIVVTVARKFKRLGALLAEMYNTYLSTVVENLVLAGVSFKYYATSVPKIVLGCCFHSVKSVLASAFQIPVQAGIEKFKVFLNCVHPVVPRVIETSFVELEETTFKPPALNGSIAIVDGFAFYYDGTLYYPTDGNSVVPICFKKKGGGDVKFSDEVSVRTIDPVYKVSLEFEFESETIMAVLNKAVGNRIKVTGGWDDVVEYINVAIEVLKDHIDVPKYYIYDEEGGTDPNLPVMVSQWPLNDDTISQDLLDVEVVTDAPIDFEGDEVDSSDPDKVADVANSEPEDDGPNVAPETNVESEVEEVAATLSFIKDTPSTVTKDPFAFDFVSYGGLKVLRQSHNNCWVTSTLVQLQLLGIVDDPAMELFSAGRVGPMVRKCYESQKAILGSLGDVSACLESLTKDLHTLKITCSVVCGCGTGERIYEGCAFRMTPTLEPFPYGACAQCAQVLMHTFKSIVGTGIFCRDTTALSLDSLVVKPLCAAAFIGKDSGHYVTNFYDAAMAIDGYGRHQIKYDTLNTICVKDVNWTAPFVPDVEPVLEPVVKPFYSYKNVDFYQGDFSDLVKLPCDFVVNAANENLSHGGGIAKAIDVYTKGMLQKCSNDYIKAHGPIKVGRGVMLEALGLKVFNVVGPRKGKHAPELLVKAYKSVFANSGVALTPLISVGIFSVPLEESLSAFLACVGDRHCKCFCYSDKEREAIINYMDGLVDAIFKDALVDTTPVQEDVQQVSQKPVLPNFEPFRIEGAHAFYECNPEGLMSLGADKLVLFTNSNLDFCSVGKCLNNVTGGALLEAINVFKKSNKTVPAGNCVTFECADMISITMVVLPSDGDANYDKNYARAVVKVSKLKGKLLLAVGDAMLYSKLSHLSVLGFVSTPDDVERFYANKSVVIKVTEDTRSVKTVKVESTVTYGQQIGPCLVNDTVVTDNKPVVADVVAKVVPSANWDSHYGFDKAGEFHMLDHTGFAFPSEVVNGRRVLKTTDNNCWVNVTCLQLQFARFRFKSAGLQAMWESYCTGDVAMFVHWLYWLTGVDKGQPSDSENALNMLSKYIVPAGSVTIERVTHDGCCCSKRVVTAPVVNASVLKLGVEDGLCPHGLNYIDKVVVVKGTTIVVNVGKPVVAPSHLFLKGVSYTTFLDNGNGVAGHYTVFDHDTGMVHDGDVFVPGDLNVSPVTNVVVSEQTAVVIKDPVKKVELDATKLLDTMNYASERFFSFGDFMSRNLITVFLYILSILGLCFRAFRKRDVKVLAGVPQRTGIILRKSVRYNAKALGVFFKLKLYWFKVLGKFSLGIYALYALLFMTIRFTPIGGPVCDDVVAGYANSSFDKNEYCNSVICKVCLYGYQELSDFSHTQVVWQHLRDPLIGNVMPFFYLAFLAIFGGVYVKAITLYFIFHYLNILGVFLGLQQSIWFLQLVPFDVFGDEIVVFFIVTRVLMFLKHVFLGCDKASCVACSKSARLKRVPVQTIFQGTSKSFYVHANGGSKFCKKHNFFCLNCDSYGPGCTFINDVIATEVGNVVKLNVQPTGPATILIDKVEFSNGFYYLYSGDTFWKYNFDITDNKYTCKESLKNCSIITDFIVFNNNGSNVNQVKNACVYFSQMLCKPVKLVDSALLASLSVDFGASLHSAFVSVLSNSFGKDLSSCNDMQDCKSTLGFDDVPLDTFNAAVAEAHRYDVLLTDMSFNNFTTSYAKPEEKLPVHDIATCMRVGAKIVNHNVLVKDSIPVVWLVRDFIALSEETRKYIIRTTKVKGITFMLTFNDCRMHTTIPTVCIANKKGAGLPSFSKVKKFFWFLCLFIVAVFFALSFFDFSTQVSSDSDYDFKYIESGQLKTFDNPLSCVHNVFSNFDQWHDAKFGFTPVNNPSCPIVVGVSDEARTVPGIPAGVYLAGKTLVFAINTIFGTSGLCFDASGVADKGACIFNSACTTLSGLGGTAVYCYKNGLVEGAKLYSELAPHSYYKMVDGNAVSLPEIISRGFGIRTIRTKAMTYCRVGQCVQSAEGVCFGADRFFVYNAESGSDFVCGTGLFTLLMNVISVFSKTVPVTVLSGQILFNCIIAFAAVAVCFLFTKFKRMFGDMSVGVFTVGACTLLNNVSYIVTQNTLGMLGYATLYFLCTKGVRYMWIWHLGFLISYILIAPWWVLMVYAFSAIFEFMPNLFKLKVSTQLFEGDKFVGSFENAAAGTFVLDMHAYERLANSISTEKLRQYASTYNKYKYYSGSASEADYRLACFAHLAKAMMDYASNHNDTLYTPPTVSYNSTLQAGLRKMAQPSGVVEKCIVRVCYGNMALNGLWLGDTVICPRHVIASSTTSTIDYDYALSVLRLHNFSISSGNVFLGVVGVTMRGALLQIKVNQNNVHTPKYTYRTVRPGESFNILACYDGSAAGVYGVNMRSNYTIRGSFINGACGSPGYNINNGTVEFCYLHQLELGSGCHVGSDLDGVMYGGYEDQPTLQVEGASSLFTENVLAFLYAALINGSTWWLSSSRIAVDRFNEWAVHNGMTTVVNTDCFSILAAKTGVDVQRLLASIQSLHKNFGGKQILGYTSLTDEFTTGEVIRQMYGVNLQSGYVSRACRNVLLVGSFLTFFWSELVSYTKFFWVNPGYVTPMFACLSLLSSLLMFTLKHKTLFFQVFLIPALIVTSCINLAFDVEVYNYLAEHFDYHVSLMGFNAQGLVNIFVCFVVTILHGTYTWRFFNTPVSSVTYVVALLTAAYNYFYASDILSCAMTLFASVTGNWFVGAVCYKAAVYMALRFPTFVAIFGDIKSVMFCYLVLGYFTCCFYGILYWFNRFFKVSVGVYDYTVSAAEFKYMVANGLRAPTGTLDSLLLSAKLIGIGGERNIKISSVQSKLTDIKCSNVVLLGCLSSMNVSANSTEWAYCVDLHNKINLCNDPEKAQEMLLALLAFFLSKNSAFGLDDLLESYFNDNSMLQSVASTYVGLPSYVIYENARQQYEDAVNNGSPPQLVKQLRHAMNVAKSEFDREASTQRKLDRMAEQAAAQMYKEARAVNRKSKVVSAMHSLLFGMLRRLDMSSVDTILNLAKDGVVPLSVIPAVSATKLNIVTSDIDSYNRIQREGCVHYAGTIWNIIDIKDNDGKVVHVKEVTAQNAESLSWPLVLGCERIVKLQNNEIIPGKLKQRSIKAEGDGIVGEGKALYNNEGGRTFMYAFISDKPDLRVVKWEFDGGCNTIELEPPRKFLVDSPNGAQIKYLYFVRNLNTLRRGAVLGYIGATVRLQAGKQTEQAINSSLLTLCAFAVDPAKTYIDAVKSGHKPVGNCVKMLANGSGNGQAVTNGVEASTNQDSYGGASVCLYCRAHVEHPSMDGFCRLKGKYVQVPLGTVDPIRFVLENDVCKVCGCWLANGCTCDRSIMQSTDMAYLNRVRGSSAARLEPCNGTDTQHVYRAFDIYNKDVACLGKFLKVNCVRLKNLDKHDAFYVVKRCTKSAMEHEQSIYSRLEKCGAVAEHDFFTWKDGRAIYGNVCRKDLTEYTMMDLCYALRNFDENNCDVLKSILIKVGACEESYFNNKVWFDPVENEDIHRVYALLGTIVSRAMLKCVKFCDAMVEQGIVGVVTLDNQDLNGDFYDFGDFTCSIKGMGIPICTSYYSYMMPVMGMTNCLASECFVKSDIFGEDFKSYDLLEYDFTEHKTALFNKYFKYWGLQYHPNCVDCSDEQCIVHCANFNTLFSTTIPITAFGPLCRKCWIDGVPLVTTAGYHFKQLGIVWNNDLNLHSSRLSINELLQFCSDPALLIASSPALVDQRTVCFSVAALGTGMTNQTVKPGHFNKEFYDFLLEQGFFSEGSELTLKHFFFAQKGDAAVKDFDYYRYNRPTVLDICQARVVYQIVQRYFDIYEGGCITAKEVVVTNLNKSAGYPLNKFGKAGLYYESLSYEEQDELYAYTKRNILPTMTQLNLKYAISGKERARTVGGVSLLSTMTTRQYHQKHLKSIVNTRGASVVIGTTKFYGGWDNMLKNLIDGVENPCLMGWDYPKCDRALPNMIRMISAMILGSKHTTCCSSTDRFFRLCNELAQVLTEVVYSNGGFYLKPGGTTSGDATTAYANSVFNIFQAVSANVNKLLSVDSNVCHNLEVKQLQRKLYECCYRSTTVDDQFVVEYYGYLRKHFSMMILSDDGVVCYNNDYASLGYVADLNAFKAVLYYQNNVFMSASKCWIEPDINKGPHEFCSQHTMQIVDKDGTYYLPYPDPSRILSAGVFVDDVVKTDAVVLLERYVSLAIDAYPLSKHENPEYKKVFYVLLDWVKHLYKTLNAGVLESFSVTLLEDSTAKFWDESFYANMYEKSAVLQSAGLCVVCGSQTVLRCGDCLRRPMLCTKCAYDHVIGTTHKFILAITPYVCCASDCGVNDVTKLYLGGLSYWCHDHKPRLAFPLCSAGNVFGLYKNSATGSPDVEDFNRIATSDWTDVSDYRLANDVKDSLRLFAAETIKAKEESVKSSYACATLHEVVGPKELLLKWEVGRPKPPLNRNSVFTCYHITKNTKFQIGEFVFEKAEYDNDAVTYKTTATTKLVPGMVFVLTSHNVQPLRAPTIANQERYSTIHKLHPAFNIPEAYSSLVPYYQLIGKQKITTIQGPPGSGKSHCVIGLGLYYPGARIVFTACSHAAVDSLCVKASTAYSNDKCSRIIPQRARVECYDGFKSNNTSAQYLFSTVNALPECNADIVVVDEVSMCTNYDLSVINQRISYRHVVYVGDPQQLPAPRVMISRGTLEPKDYNVVTQRMCALKPDVFLHKCYRCPAEIVRTVSEMVYENQFIPVHPDSKQCFKIFCKGNVQVDNGSSINRRQLDVVRMFLAKNPRWSKAVFISPYNSQNYVASRMLGLQIQTVDSSQGSEYDYVIYTQTSDTAHACNVNRFNVAITRAKKGILCIMCDRSLFDVLKFFELKLSDLQANEGCGLFKDCSRGDDLLPPSHANTFMSLADNFKTDQDLAVQIGVNGPIKYEHVISFMGFRFDINIPNHHTLFCTRDFAMRNVRGWLGFDVEGAHVVGSNVGTNVPLQLGFSNGVDFVVRPEGCVVTESGDYIKPVRARAPPGEQFAHLLPLLKRGQPWDVVRKRIVQMCSDYLANLSDILIFVLWAGGLELTTMRYFVKIGPSKSCDCGKVATCYNSALHTYCCFKHALGCDYLYNPYCIDIQQWGYKGSLSLNHHEHCNVHRNEHVASGDAIMTRCMAIHDCFVKNVDWSITYPFIGNEAVINKSGRIVQSHTMRSVLKLYNPKAIYDIGNPKGIRCAVTDAKWFCFDKNPTNSNVKTLEYDYITHGQFDGLCLFWNCNVDMYPEFSVVCRFDTRCRSPLNLEGCNGGSLYVNNHAFHTPAFDKRAFAKLKPMPFFFYDDTECDKLQDSINYVPLRASNCITKCNVGGAVCSKHCAMYHSYVNAYNTFTSAGFTIWVPTSFDTYNLWQTFSNNLQGLENIAFNVVKKGSFVGAEGELPVAVVNDKVLVRDGTVDTLVFTNKTSLPTNVAFELYAKRKVGLTPPITILRNLGVVCTSKCVIWDYEAERPLTTFTKDVCKYTDFEGDVCTLFDNSIVGSLERFSMTQNAVLMSLTAVKKLTGIKLTYGYLNGVPVNTHEDKPFTWYIYTRKNGKFEDHPDGYFTQGRTTADFSPRSDMEKDFLSMDMGLFINKYGLEDYGFEHVVYGDVSKTTLGGLHLLISQVRLACMGVLKIDEFVSSNDSTLKSCTVTYADNPSSKMVCTYMDLLLDDFVSILKSLDLGVVSKVHEVMVDCKMWRWMLWCKDHKLQTFYPQLQASEWKCGYSMPSIYKIQRMCLEPCNLYNYGAGIKLPDGIMFNVVKYTQLCQYLNSTTMCVPHHMRVLHLGAGSDKGVAPGTAVLRRWLPLDAIIVDNDSVDYVSDADYSVTGDCSTLYLSDKFDLVISDMYDGKIKSCDGENVSKEGFFPYINGVITEKLALGGTVAIKVTEFSWNKKLYELIQRFEYWTMFCTSVNTSSSEAFLIGVHYLGDFASGAVIDGNTMHANYIFWRNSTIMTMSYNSVLDLSKFNCKHKATVVINLKDSSISDVVLGLLKNGKLLVRNNDAICGFSNHLVNVNK

SEQ ID NO: 53 - protein, 4117 aa, Porcine Epidemic Diarrhea Virus
MASNHVTLAFANDAEISAFGFCTASEAVSYYSEAAASGFMQCRFVSFDLADTVEGLLPEDYVMVVVGTTKLSAYVDTFGSRPKNICGWLLFSNCNYFLEELELTFGRRGGNIVPVDQYMCGADGKPVLQESEWEYTDFFADSEDGQLNIAGITYVKAWIVERSDVSYASQNLTSIKSITYCSTYEHTFPDGTAMKVARTPKIKKTVVLSEPLATIYREIGSPFVDNGSDARSIIKRPVFLHAFVKCKCGSYHWTVGDWTSYVSTCCGFKCKPVLVASCSATPGSVVITRAGAGTGVKYYNNMFLRHVADIDGLSFWRILKVQSKDDLACSGKFLEHHEEGFTDPCYFLNDSSIATKLKFDILSGKFSDEVKQAIFAGHVVVGSALVDIVDDALGQPWFIRKLGDLASAAWEQLKAVVRGLNLLSDEVVLFGKRLSCATLSIVNGVFEFIAEVPEKLAAAVTVFVNFLNELFESACDCLKVGGKTFNKVGSYVLFDNALVKLVKAKVRGPRQAGVCEVRYTSLVIGSTTKVVSKRVENANVNLVVVDEDVTLNTTGRTVVVDGLAFFESDGFYRHLADADVVIEHPVYKSACELKPVFECDPIPDFPMPVAASVAELCVQTDLLLKNYNTPYKTYSCVVRGDKCCITCTLHITAPSYMEDAANFVDLCTKNIGTAGFHEFYITAHEQQDLQGFVTTCCTMSGFECFMPIIPQCPAVLEEIDGGSIWRSFITGLNTMWDFCKHLKVSFGLDGIVVTVARKFKRLGALLAEMYNTYLSTVVENLVLAGVSFKYYATSVPKIVLGCCFHSVKSVLASAFQIPVQAGIEKFKVFLNCVHPVVPRVIETSFVELEETTFKPPALNGSIAIVDGFAFYYDGTLYYPTDGNSVVPICFKKKGGGDVKFSDEVSVRTIDPVYKVSLEFEFESETIMAVLNKAVGNRIKVTGGWDDVVEYINVAIEVLKDHIDVPKYYIYDEEGGTDPNLPVMVSQWPLNDDTISQDLLDVEVVTDAPIDFEGDEVDSSDPDKVADVANSEPEDDGPNVAPETNVESEVEEVAATLSFIKDTPSTVTKDPFAFDFVSYGGLKVLRQSHNNCWVTSTLVQLQLLGIVDDPAMELFSAGRVGPMVRKCYESQKAILGSLGDVSACLESLTKDLHTLKITCSVVCGCGTGERIYEGCAFRMTPTLEPFPYGACAQCAQVLMHTFKSIVGTGIFCRDTTALSLDSLVVKPLCAAAFIGKDSGHYVTNFYDAAMAIDGYGRHQIKYDTLNTICVKDVNWTAPFVPDVEPVLEPVVKPFYSYKNVDFYQGDFSDLVKLPCDFVVNAANENLSHGGGIAKAIDVYTKGMLQKCSNDYIKAHGPIKVGRGVMLEALGLKVFNVVGPRKGKHAPELLVKAYKSVFANSGVALTPLISVGIFSVPLEESLSAFLACVGDRHCKCFCYSDKEREAIINYMDGLVDAIFKDALVDTTPVQEDVQQVSQKPVLPNFEPFRIEGAHAFYECNPEGLMSLGADKLVLFTNSNLDFCSVGKCLNNVTGGALLEAINVFKKSNKTVPAGNCVTFECADMISITMVVLPSDGDANYDKNYARAVVKVSKLKGKLLLAVGDAMLYSKLSHLSVLGFVSTPDDVERFYANKSVVIKVTEDTRSVKTVKVESTVTYGQQIGPCLVNDTVVTDNKPVVADVVAKVVPSANWDSHYGFDKAGEFHMLDHTGFAFPSEVVNGRRVLKTTDNNCWVNVTCLQLQFARFRFKSAGLQAMWESYCTGDVAMFVHWLYWLTGVDKGQPSDSENALNMLSKYIVPAGSVTIERVTHDGCCCSKRVVTAPVVNASVLKLGVEDGLCPHGLNYIDKVVVVKGTTIVVNVGKPVVAPSHLFLKGVSYTTFLDNGNGVAGHYTVFDHDTGMVHDGDVFVPGDLNVSPVTNVVVSEQTAVVIKDPVKKVELDATKLLDTMNYASERFFSFGDFMSRNLITVFLYILSILGLCFRAFRKRDVKVLAGVPQRTGIILRKSVRYNAKALGVFFKLKLYWFKVLGKFSLGIYALYALLFMTIRFTPIGGPVCDDVVAGYANSSFDKNEYCNSVICKVCLYGYQELSDFSHTQVVWQHLRDPLIGNVMPFFYLAFLAIFGGVYVKAITLYFIFHYLNILGVFLGLQQSIWFLQLVPFDVFGDEIVVFFIVTRVLMFLKHVFLGCDKASCVACSKSARLKRVPVQTIFQGTSKSFYVHANGGSKFCKKHNFFCLNCDSYGPGCTFINDVIATEVGNVVKLNVQPTGPATILIDKVEFSNGFYYLYSGDTFWKYNFDITDNKYTCKESLKNCSIITDFIVFNNNGSNVNQVKNACVYFSQMLCKPVKLVDSALLASLSVDFGASLHSAFVSVLSNSFGKDLSSCNDMQDCKSTLGFDDVPLDTFNAAVAEAHRYDVLLTDMSFNNFTTSYAKPEEKLPVHDIATCMRVGAKIVNHNVLVKDSIPVVWLVRDFIALSEETRKYIIRTTKVKGITFMLTFNDCRMHTTIPTVCIANKKGAGLPSFSKVKKFFWFLCLFIVAVFFALSFFDFSTQVSSDSDYDFKYIESGQLKTFDNPLSCVHNVFSNFDQWHDAKFGFTPVNNPSCPIVVGVSDEARTVPGIPAGVYLAGKTLVFAINTIFGTSGLCFDASGVADKGACIFNSACTTLSGLGGTAVYCYKNGLVEGAKLYSELAPHSYYKMVDGNAVSLPEIISRGFGIRTIRTKAMTYCRVGQCVQSAEGVCFGADRFFVYNAESGSDFVCGTGLFTLLMNVISVFSKTVPVTVLSGQILFNCIIAFAAVAVCFLFTKFKRMFGDMSVGVFTVGACTLLNNVSYIVTQNTLGMLGYATLYFLCTKGVRYMWIWHLGFLISYILIAPWWVLMVYAFSAIFEFMPNLFKLKVSTQLFEGDKFVGSFENAAAGTFVLDMHAYERLANSISTEKLRQYASTYNKYKYYSGSASEADYRLACFAHLAKAMMDYASNHNDTLYTPPTVSYNSTLQAGLRKMAQPSGVVEKCIVRVCYGNMALNGLWLGDTVICPRHVIASSTTSTIDYDYALSVLRLHNFSISSGNVFLGVVGVTMRGALLQIKVNQNNVHTPKYTYRTVRPGESFNILACYDGSAAGVYGVNMRSNYTIRGSFINGACGSPGYNINNGTVEFCYLHQLELGSGCHVGSDLDGVMYGGYEDQPTLQVEGASSLFTENVLAFLYAALINGSTWWLSSSRIAVDRFNEWAVHNGMTTVVNTDCFSILAAKTGVDVQRLLASIQSLHKNFGGKQILGYTSLTDEFTTGEVIRQMYGVNLQSGYVSRACRNVLLVGSFLTFFWSELVSYTKFFWVNPGYVTPMFACLSLLSSLLMFTLKHKTLFFQVFLIPALIVTSCINLAFDVEVYNYLAEHFDYHVSLMGFNAQGLVNIFVCFVVTILHGTYTWRFFNTPVSSVTYVVALLTAAYNYFYASDILSCAMTLFASVTGNWFVGAVCYKAAVYMALRFPTFVAIFGDIKSVMFCYLVLGYFTCCFYGILYWFNRFFKVSVGVYDYTVSAAEFKYMVANGLRAPTGTLDSLLLSAKLIGIGGERNIKISSVQSKLTDIKCSNVVLLGCLSSMNVSANSTEWAYCVDLHNKINLCNDPEKAQEMLLALLAFFLSKNSAFGLDDLLESYFNDNSMLQSVASTYVGLPSYVIYENARQQYEDAVNNGSPPQLVKQLRHAMNVAKSEFDREASTQRKLDRMAEQAAAQMYKEARAVNRKSKVVSAMHSLLFGMLRRLDMSSVDTILNLAKDGVVPLSVIPAVSATKLNIVTSDIDSYNRIQREGCVHYAGTIWNIIDIKDNDGKVVHVKEVTAQNAESLSWPLVLGCERIVKLQNNEIIPGKLKQRSIKAEGDGIVGEGKALYNNEGGRTFMYAFISDKPDLRVVKWEFDGGCNTIELEPPRKFLVDSPNGAQIKYLYFVRNLNTLRRGAVLGYIGATVRLQAGKQTEQAINSSLLTLCAFAVDPAKTYIDAVKSGHKPVGNCVKMLANGSGNGQAVTNGVEASTNQDSYGGASVCLYCRAHVEHPSMDGFCRLKGKYVQVPLGTVDPIRFVLENDVCKVCGCWLANGCTCDRSIMQSTDMAYLNEYGALVQLD

SEQ ID NO: 54 - protein, 1386 aa, Porcine Epidemic Diarrhea Virus
MKSLTYFWLFLPVLSTLSLPQDVTRCSANTNFRRFFSKFNVQAPAVVVLGGYLPIGENQGVNSTWYCAGQHPTASGVHGIFVSHIRGGHGFEIGISQEPFDPSGYQLYLHKATNGNTNATARLRICQFPSIKTLGPTANNDVTTGRNCLFNKAIPAHMSEHSVVGITWDNDRVTVFSDKIYYFYFKNDWSRVATKCYNSGGCAMQYVYEPTYYMLNVTSAGEDGISYQPCTANCIGYAANVFATEPNGHIPEGFSFNNWFLLSNDSTLVHGKVVSNQPLLVNCLLAIPKIYGLGQFFSFNQTIDGVCNGAAVQRAPEALRFNINDTSVILAEGSIVLHTALGTNFSFVCSNSSNPHLATFAIPLGATQVPYYCFFKVDTYNSTVYKFLAVLPPTVREIVITKYGDVYVNGFGYLHLGLLDAVTINFTGHGTDDDVSGFWTIASTNFVDALIEVQGTAIQRILYCDDPVSQLKCSQVAFDLDDGFYPISSRNLLSHEQPISFVTLPSFNDHSFVNITVSASFGGHSGANLIASDTTINGFSSFCVDTRQFTISLFYNVTNSYGYVSKSQDSNCPFTLQSVNDYLSFSKFCVSTSLLASACTIDLFGYPEFGSGVKFTSLYFQFTKGELITGTPKPLEGVTDVSFMTLDVCTKYTIYGFKGEGIITLTNSSFLAGVYYTSDSGQLLAFKNVTSGAVYSVTPCSFSEQAAYVDDDIVGVISSLSSSTFNSTRELPGFFYHSNDGSNCTEPVLVYSNIGVCKSGSIGYVPSQSGQVKIAPTVTGNISIPTNFSMSIRTEYLQLYNTPVSVDCATYVCNGNSRCKQLLTQYTAACKTIESALQLSARLESVEVNSMLTISEEALQLATISSFNGDGYNFTNVLGVSVYDPASGRVVQKRSFIEDLLFNKVVTNGLGTVDEDYKRCSNGRSVADLVCAQYYSGVMVLPGVVDAEKLHMYSASLIGGMVLGGFTSAAALPFSYAVQARLNYLALQTDVLQRNQQLLAESFNSAIGNITSAFESVKEAISQTSKGLNTVAHALTKVQEVVNSQGAALTQLTVQLQHNFQAISSSIDDIYSRLDILSADVQVDRLITGRLSALNAFVAQTLTKYTEVQASRKLAQQKVNECVKSQSQRYGFCGGDGEHIFSLVQAAPQGLLFLHTVLVPSDFVDVIAIAGLCVNDEIALTLREPGLVLFTHELQNHTATEYFVSSRRMFEPRKPTVSDFVQIESCVVTYVNLTRDQLPDVIPDYIDVNKTLDEILASLPNRTGPSLPLDVFNATYLNLTGEIADLEQRSESLRNTTEELQSLIYNINNTLVDLEWLNRVETYIKWPWWVWLIIFIVLIFVVSLLVFCCISTGCCGCCGCCCACFSGCCRGPRLQPYEVFEKVHVQ

SEQ ID NO: 55 - protein, 224 aa, Porcine Epidemic Diarrhea Virus
MFLGLFQYTIDTVVKDVSKSANLSLDAVQELELNVVPIRQASNVTGFLFTSVFIYFFALFKASSLRRNYIMLAARFAVIVLYCPLLYYCGAFLDATIICCTLIGRLCLVCFYSWRYKNALFIIFNTTTLSFLNGKAAYYDGKSIVILEGGDHYITFGNSFVAFVSSIDLYLAIRGRQEADLQLLRTVELLDGKKLYVFSQHQIVGITNAAFYSIQLDEYATISE

SEQ ID NO: 56 - protein, 76 aa, Porcine Epidemic Diarrhea Virus; identical to SEQ ID NO: 20

SEQ ID NO: 57 - protein, 226 aa, Porcine Epidemic Diarrhea Virus; identical to SEQ ID NO: 21

SEQ ID NO: 58 - protein, 441 aa, Porcine Epidemic Diarrhea Virus
MASVSFQDRGRKRVPLSLYAPLRVTNDKPLSKVLANNAVPTNKGNKDQQIGYWNEQIRWRMRRGERIEQPSNWHFYYLGTGPHADLRYRTRTEGVFWVAKEGAKTEPTNLGVRKASEKPIIPNFSQQLPSVVEIVEPNTPPTSRANSRSRSRGNGNNRSRSPSNNRGNNQSRGNSQNRGNNQGRGASQNRGGNNNNNNKSRNQSKNRNQSNDRGGVTSRDDLVAAVKDALKSLGIGENPDKLKQQQKPKQERSDSSGKNTPKKNKSRATSKERDLKDIPEWRRIPKGENSVAACFGPRGGFKNFGDAEFVEKGVDASGYAQIASLAPNVAALLFGGNVAVRELADSYEITYNYKMTVPKSDPNVELLVSQVDAFKTGNAKPQRKKEKKNKRETTQQLNEEAIYDDVGVPSDVTHANLEWDTAVDGGDTAVEIINEIFDTGN

SEQ ID NO: 59 - DNA, 28038 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttttccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtgattacgcgcgctggtgctggcactggtgttaagtattacaacaacatgttcctgcgccatgtggcagacattgatgggttgtcattctggcgaattctcaaggtgcagtccaaagacgacctcgcttgctctggtaaattccttgaacaccacgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgtaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttctgacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtatggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtaattcatactgctttaggaacaaatttttcttttgtttgcagtaattcctcaaatcctcacttagccaccttcgccatacctttgggtgctacccaagtaccctattattgtttttttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcattctactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 60 - DNA, 28038 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgcaccttacatttcacagcaccaagttatatggaggctgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgttagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttttagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacactcgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttctctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaacactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgacgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaatacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctttatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttttgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcactggttatgctgccaatgtatttgctactgagcccaatggccacataccagaaggttttagttttaataattggtttcttttgtccaatgattccactttggtgcatggtaaggtggtttctaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtgatgttaagtttacgtccctttactttcaattcacaaagggtgagttgattactggcacgcctaaaccatttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaattttgaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 61 - DNA, 28038 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatctttctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgcctttcagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccttgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaactccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgttaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacatacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgagaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaattatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatatggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaagtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagtactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaataagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatacaagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcggggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcccagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagctaccttcgccatacctctgggtgctacccaagtaccttattattgtttttttaaagtggatacttacaactccactgtttataaatttttggctgttttacctcctaccgtcagggaaattgtcatcaccaagtatggtgatgtttatgtcaatggggttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacattactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattttggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttgttgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcttgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggtagaccgtctcatcaacggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccttggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaggcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccttccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatttgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 62 - DNA, 27973 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatctgatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcgagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgttggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtttatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaacaaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgcttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttaaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccatttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcctttgttgcttttgttagtagcatcgacttgtatctagctatacaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaatagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 63 - DNA, 28029 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggttttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtttatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaacaaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattcctgcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgcttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcctttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 64 - DNA, 27973 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatctgatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcgagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgttggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtttatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaacaaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgcttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttaaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcacgtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccatttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcctttgttgcttttgttagtagcatcgacttgtatctagctatacaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaatagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 65 - DNA, 27973 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatctgatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcgagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgttggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtttatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaacaaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtctactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgcttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgttccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcacgtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggcgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccatttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcctttgttgcttttgttagtagcattgacttgtatctagctatacaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaatagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 66 - DNA, 27954 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatctgatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagttttcgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgtcgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctatgcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagtccttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcgagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctttctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgttggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtttatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaacaaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgattcaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtagcaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtctactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgcttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgttccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcacgtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggcgctaggaggttttacttctgcagcggcattgccttttagccatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggacacctatgtcaatttgactagagaccaactaccagatgtaatcccagattacatcgatgttaacaaaacacttgatgagattttagcttctctgcccaatagaactggtccaagtcttcctttagatgtttttaatgccatttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatagtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttatgacggcaaatccattgtgattttagaaggtggtgaccattacatcacttttggcaactcctttgttgcttttgttagtagcattgacttgtatctagctatacaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagttttacatgcaaatagaccccctccctagtactgttattgacgtataaacgaaatatgtctaacggtgctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtattggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaatagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 67 - DNA, 28029 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgttttgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaataaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttttgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactattaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcctttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatcacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 68 - DNA, 28026 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgttttgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaataaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttttgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactattaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttatgacggcaaatccattgtgattttagaaggtggtgaccattacatcacttttggcaactcctttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatcacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 69 - DNA, 28038 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtgattacgcgcgctggtgctggcactggtgttaagtattacaacaacatgttcctgcgccatgtggcagacattgatgggttgtcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttctgacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtatggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctttgggtgctacccaagtaccctattattgttttcttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcattctactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 70 - DNA, 28038 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtgattacgcgcgctggtgctggcactggtgttaagtattacaacaacatgttcctgcgccatgtggcagacattgatgggttgtcattctggcgaattctcaaggtgcagtccaaagacgacctcgcttgctctggtaaattccttgaacaccacgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgtaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttctgacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtatggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttagtaattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctttgggtgctacccaagtaccctattattgtttttttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtcyaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcattctactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 71 - DNA, 28038 bp, Porcine Epidemic Diarrhea Virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtgattacgcgcgctggtgctggcactggtgttaagtattacaacaacatgttcctgcgccatgtggcagacattgatgggttgtcattctggcgaattctcaaggtgcagtccaaagacgacctcgcttgctctggtaaattccttgaacaccacgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgtaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttctgacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtatggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacatctctgtcattcttgctgaaggctcaattgtacttcatactgctttaggaacaaatttttcttttgtttgcagtaattcctcaaatcctcacttagccaccttcgccatacctttgggtgctacccaagtaccctattattgtttttttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtcgcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaatttgacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcattctactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactggtattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 72 - DNA, 28038 bp, Porcine Epidemic Diarrhea Virus
acttaaaaagattttctatctacagatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtgattacgcgcgctggtgctggcactggtgttaagtattacaacaacatgttcctgcgccatgtggcagacattgatgggttgtcattctggcgaattctcaaggtgcagtccaaagacgacctcgcttgctctggtaaattccttgaacaccacgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgtaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttttattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttctgacttctctcacacacaggtggtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaactatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtgcaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtatggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacatctctgtcattcttgctgaaggctcaattgtacttcatactgctttaggaacaaatttttcttttgtttgcagtaattcctcaaatcctcacttagccaccttcgccatacctttgggtgctacccaagtaccctattattgtttttttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagataccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtcgcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttattttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgcctcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaatttgacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcattctactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagttgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggactgggacacagctgttgttggtggtgacacggccgttgaaattatcaacgagatcttcgacacaggaaattaaacaatgtttgactggcttatcctggctatgtcccagggtagtgccattacactggtattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 73 - DNA, 28038 bp, Porcine Epidemic Diarrhea Virus
acttaaaaagattttctatctacagatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtgattacgcgcgctggtgctggcactggtgttaagtattacaacaacatgttcctgcgccatgtggcagacattgatgggttgtcattctggcgaattctcaaggtgcagtccaaagacgacctcgcttgctctggtaaattccttgaacaccacgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgtaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttttattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacattggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttctgacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaactatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctatttttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtatggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacatctctgtcattcttgctgaaggctcaattgtacttcatactgctttaggaacaaatttttcttttgtttgcagtaattcctcaaatcctcacttagccaccttcgccatacctttgggtgctacccaagtaccctattattgtttttttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagataccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtcgcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttattttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgcctcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaatttgacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcattctactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccatccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcaactgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacataggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 74 - DNA, 28038 bp, Porcine Epidemic Diarrhea Virus
acttaaaaagattttctatctacagatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtgattacgcgcgctggtgctggcactggtgttaagtattacaacaacatgttcctgcgccatgtggcagacattgatgggttgtcattctggcgaattctcaaggtgcagtccaaagacgacctcgcttgctctggtaaattccttgaacaccacgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgtaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttttattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacattggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttctgacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaactatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctatttttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgttgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtatggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaacgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacatctctgtcattcttgctgaaggctcaattgtacttcatactgctttaggaacaaatttttcttttgtttgcagtaattcctcaaatcctcacttagccaccttcgccatacctttgggtgctacccaagtaccctattattgtttttttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagataccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtcgcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttattttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcacctttgttgtgtcattactagtgttctgctgcatttccacgggttgttgtggatgcctcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaatttgacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcattctactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccatccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcaactgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacataggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 75 - DNA, 28038 bp, Porcine Epidemic Diarrhea Virus
acttaaaaagattttctatctacagatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcccctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtgattacgcgcgctggtgctggcactggtgttaagtattacaacaacatgttcctgcgccatgtggcagacattgatgggttgtcattctggcgaattctcaaggtgcagtccaaagacgacctcgcttgctctggtaaattccttgaacaccacgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgtcttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgtaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttttattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacattggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttctgacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaacattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaactatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctatttttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgttgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtatggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaacgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacatctctgtcattcttgctgaaggctcaattgtacttcatactgctttaggaacaaatttttcttttgtttgcagtaattcctcaaatcctcacttagccaccttcgccatacctttgggtgctacccaagtaccctattattgtttttttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagataccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagacgcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttattttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcacctttgttgtgtcattactagtgttctgctgcatttccacgggttgttgtggatgcctcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaatttgacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcattctactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccatccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcaactgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcttacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacataggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 76 - DNA, 28004 bp, Porcine Epidemic Diarrhea Virus
ctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgttttgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatatggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaataaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttttgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactattaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagccatgctgttcaagctagactcaattatcttgctctacagacggatgttctacagcggaaccagcaattgcttgctgagtcttttaactctgctattggtaatataactccagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagctttgacggcaaatccattgtgattttagaaggtggtgaccattacatcacttttggcaactcctttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatcacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatgg

SEQ ID NO: 77 - DNA, 28002 bp, Porcine Epidemic Diarrhea Virus
tctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgttttgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgacccccaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatatggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaataaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttttgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactattaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagccatgctgttcaagctagactcaattatcttgctctacagacggatgttctacagcggaaccagcaattgcttgctgagtcttttaactctgctattggtaatataactccagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagctttgacggcaaatccattgtgattttagaaggtggtgaccattacatcacttttggcaactcctttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatcacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatgga

SEQ ID NO: 78 - DNA, 27886 bp, Porcine Epidemic Diarrhea Virus
ctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatctgatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgcgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgtaccttacatttcacagcaccaagttatatggaggctgctgctaattttgtagacctctgtaccaagaacattggtactgctggttttcatgagttttacattacggcccatgaacaacaggatctgcaagggtttgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaggggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcgagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatactgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtttcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgttggaatatgatttcacggagcataagacagcactcttcaacaagtatttcaagtattggggactgcaataccaccctaactgtgtggactgcagtgatgagcagtgcatagttcactgtgccaatttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtttatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaacaaacttcttagtgttgacagcaatgtctgtcataatttagaagttaagcaattgcagcgtaagctttatgagtgctgttatagatcaactaccgttgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgattcaactaagctctatttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaaccaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtagcaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaacctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtctactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgcttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttctatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgttccatctcagtctggtcaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcacgtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggcgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccatttatcttaatctcactggtgaaattgcagatttagagcagcgttcagagtctctccgtaatactacagaggagcttcaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatagtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttatgacggcaaatccattgtgattttagaaggtggtgaccattacatcacttttggcaactcctttgttgcttttgttagtagcattgacttgtatctagctatacaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagttttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtattggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggactgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaatagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccgaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttag

We claim:

1. An isolated Porcine Epidemic Diarrhea Virus (PEDV) encoded by a DNA polynucleotide sequence that is SEQ ID NO: 36 or SEQ ID NO: 37.

2. A vaccine composition comprising a porcine epidemic diarrhea virus (PEDV) according to claim 1, and a carrier, wherein said composition is capable of protecting swine from challenge by both variant and prototype strains of PEDV and preventing or treating one or more symptoms associated with PEDV infection, and wherein achievement of protection is determined by an endpoint selected from the group consisting of prevention or control of any of the PEDV infection symptoms of dehydration, fever, diarrhea, vomiting, poor lactational performance, poor reproduction performance, mortality, and prevention or control of weight loss or failure to gain weight.

3. The vaccine composition of claim 2 wherein the virus is live or killed.

4. The vaccine composition of claim 2 wherein said carrier is a diluent.

5. The vaccine composition of claim 2 further comprising an adjuvant.

6. The vaccine composition of claim 2 wherein said protected swine include any of sows, gilts, boars, hogs, and piglets.

7. The vaccine composition of claim 5 wherein the adjuvant is de-oiled lecithin dissolved in an oil and aluminum hydroxide.

8. The vaccine composition of claim 5, wherein said adjuvant is CpG/DEAE-dextran/mineral oil (TXO).

9. A method of preventing disease in a piglet caused by PEDV, said method comprising administering to said piglet the vaccine composition of claim 2, wherein a first dose of said vaccine is administered when the piglet is about 1-7 days old.

10. The method of claim 9, wherein said administering further comprises administering a second dose of said vaccine when the piglet is about 2-5 weeks old.

11. The method of claim 9, wherein 2 doses are administered to the piglet, and the parent sow, although vaccinated pre-breeding, was not vaccinated pre-farrowing.

12. The method of claim 9, wherein 2 doses are administered to the piglet, and the parent sow is vaccinated pre-farrowing.

13. The method of claim 9, wherein only a single dose is administered to the piglet, and wherein the mother sow of the piglet is naïve to PEDV, and is not, at any time, vaccinated.

14. An isolated Porcine Epidemic Diarrhea Virus (PEDV) that is encoded by a DNA polynucleotide sequence that is at least 95% or 99% identical, at a full length nucleotide level, to SEQ ID: NO:37, wherein said nucleotide sequence comprises one or both of (1) an ORF1a/1b protein having a proline residue at the amino acid position thereof corresponding to position 551 in SEQ ID NO:46; and (2) a spike protein having a histidine residue at the amino acid position thereof corresponding to position 973 in SEQ ID NO: 47.

15. A full length RNA polynucleotide that corresponds to the encoding DNA polynucleotide of claim 1, or the complement thereof.

16. The RNA polynucleotide of claim 15 that is an infectious clone.

17. A plasmid or bacterial artificial chromosome that comprises the encoding DNA polynucleotide of claim 1.

* * * * *